US012600971B2

(12) United States Patent
Gaudelli et al.

(10) Patent No.: US 12,600,971 B2
(45) Date of Patent: Apr. 14, 2026

(54) MODIFIED IMMUNE CELLS HAVING ADENOSINE DEAMINASE BASE EDITORS FOR MODIFYING A NUCLEOBASE IN A TARGET SEQUENCE

(71) Applicant: BEAM THERAPEUTICS INC., Cambridge, MA (US)

(72) Inventors: Nicole Gaudelli, Cambridge, MA (US); Michael Packer, Cambridge, MA (US); Ian Slaymaker, Cambridge, MA (US); Yi Yu, Cambridge, MA (US); Bernd Zetsche, Cambridge, MA (US); David A. Born, Cambridge, MA (US); Seung-Joo Lee, Cambridge, MA (US); Jason M. Gehrke, Cambridge, MA (US)

(73) Assignee: BEAM THERAPEUTICS INC., Cambridge, MA (US)

( * ) Notice: Subject to any disclaimer, the term of this patent is extended or adjusted under 35 U.S.C. 154(b) by 314 days.

(21) Appl. No.: 17/430,676

(22) PCT Filed: Feb. 13, 2020

(86) PCT No.: PCT/US2020/018178
§ 371 (c)(1),
(2) Date: Aug. 12, 2021

(87) PCT Pub. No.: WO2020/168122
PCT Pub. Date: Aug. 20, 2020

(65) Prior Publication Data
US 2023/0080198 A1     Mar. 16, 2023

Related U.S. Application Data

(60) Provisional application No. 62/966,526, filed on Jan. 27, 2020, provisional application No. 62/941,523, filed on Nov. 27, 2019, provisional application No. 62/941,569, filed on Nov. 27, 2019, provisional application No. 62/931,722, filed on Nov. 6, 2019, provisional application No. 62/852,224, filed on May 23, 2019, provisional application No. 62/852,228, filed on May 23, 2019, provisional application No. 62/805,271, filed on Feb. 13, 2019.

(51) Int. Cl.
*C12N 15/113*     (2010.01)
*C12N 9/22*     (2006.01)
*C12N 9/78*     (2006.01)

(52) U.S. Cl.
CPC ............ *C12N 15/1138* (2013.01); *C12N 9/22* (2013.01); *C12N 9/78* (2013.01); *C12N 2310/20* (2017.05); *C12N 2310/315* (2013.01); *C12N 2310/346* (2013.01); *C12N 2320/33* (2013.01); *C12N 2510/00* (2013.01); *C12Y 305/04004* (2013.01)

(58) Field of Classification Search
CPC ...................................................... C12N 9/222
See application file for complete search history.

(56) References Cited

U.S. PATENT DOCUMENTS

| | | | |
|---|---|---|---|
| 7,915,114 B2 | 3/2011 | Hsiao et al. |
| 9,068,179 B1 | 6/2015 | Liu et al. |
| 9,322,037 B2 | 4/2016 | Liu et al. |
| 9,388,430 B2 | 7/2016 | Liu et al. |
| 9,512,446 B1 | 12/2016 | Joung et al. |
| 9,737,604 B2 | 8/2017 | Liu et al. |
| 9,783,591 B2 | 10/2017 | June et al. |
| 9,840,699 B2 | 12/2017 | Liu et al. |
| 10,113,163 B2 | 10/2018 | Liu et al. |
| 10,167,457 B2 | 1/2019 | Liu et al. |
| 10,465,176 B2 | 11/2019 | Liu et al. |
| 10,501,519 B2 | 12/2019 | June et al. |
| 10,526,401 B2 | 1/2020 | Muir et al. |
| 10,682,410 B2 | 6/2020 | Liu et al. |
| 10,745,677 B2 | 8/2020 | Maianti et al. |
| 10,912,833 B2 | 2/2021 | Liu et al. |
| 10,947,530 B2 | 3/2021 | Liu et al. |
| 10,968,426 B2 | 4/2021 | Meissner |
| 11,053,481 B2 | 7/2021 | Liu et al. |
| 11,090,336 B2 | 8/2021 | Posey et al. |
| 11,124,782 B2 | 9/2021 | Liu et al. |

(Continued)

FOREIGN PATENT DOCUMENTS

| | | |
|---|---|---|
| CN | 103088008 A | 5/2013 |
| CN | 105934516 A | 9/2016 |

(Continued)

OTHER PUBLICATIONS

Preece et al. Emerging CRISPR/Cas9 applications for T-cell gene editing. Emerging Topics in Life Sciences 2019, 3:261-275. (Year: 2019).*

(Continued)

*Primary Examiner* — Christopher M Babic
*Assistant Examiner* — Jennifer S Spence
(74) *Attorney, Agent, or Firm* — Greenberg Traurig, LLP; Melissa Hunter-Ensor; Nicholas R. Ballor

(57) ABSTRACT

The present invention features genetically modified immune cells comprising novel adenosine base editors (e.g., ABE8) having enhanced anti-neoplasia activity, resistance to immune suppression, and decreased risk of eliciting a graft-versus-host reaction or host-versus-graft reaction, or a combination thereof. The present invention also features methods for producing and using these modified immune effector cells.

22 Claims, 15 Drawing Sheets

Specification includes a Sequence Listing.

(56) References Cited

U.S. PATENT DOCUMENTS

| | | |
|---|---|---|
| 11,142,550 B2 | 10/2021 | Muir et al. |
| 11,142,760 B2 | 10/2021 | Slaymaker et al. |
| 11,155,803 B2 | 10/2021 | Gaudelli et al. |
| 11,193,123 B2 | 12/2021 | Halperin |
| 11,214,780 B2 | 1/2022 | Liu et al. |
| 11,268,082 B2 | 3/2022 | Liu et al. |
| 11,306,324 B2 | 4/2022 | Liu et al. |
| 11,319,532 B2 | 5/2022 | Liu et al. |
| 11,344,609 B2 | 5/2022 | Slaymaker et al. |
| 11,479,767 B2 | 10/2022 | Smith et al. |
| 11,542,496 B2 | 1/2023 | Liu et al. |
| 11,732,274 B2 | 8/2023 | Liu et al. |
| 11,866,727 B2 | 1/2024 | Cowan et al. |
| 12,129,478 B1 | 10/2024 | Chen et al. |
| 12,241,096 B2 | 3/2025 | Joung et al. |
| 2004/0003420 A1 | 1/2004 | Kuhn et al. |
| 2004/0115184 A1 | 6/2004 | Smith et al. |
| 2005/0222030 A1 | 10/2005 | Allison |
| 2011/0104787 A1 | 5/2011 | Church et al. |
| 2013/0109048 A1 | 5/2013 | Giugliano et al. |
| 2014/0068797 A1 | 3/2014 | Doudna et al. |
| 2014/0186958 A1 | 7/2014 | Zhang et al. |
| 2014/0273226 A1 | 9/2014 | Wu |
| 2014/0273230 A1 | 9/2014 | Chen et al. |
| 2014/0356956 A1 | 12/2014 | Church et al. |
| 2014/0370045 A1 | 12/2014 | June et al. |
| 2015/0056225 A1 | 2/2015 | Russell |
| 2015/0071903 A1 | 3/2015 | Liu et al. |
| 2015/0165054 A1 | 6/2015 | Liu et al. |
| 2015/0166980 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0344549 A1 | 12/2015 | Muir et al. |
| 2016/0046961 A1 | 2/2016 | Jinek et al. |
| 2016/0200779 A1 | 7/2016 | Liu et al. |
| 2016/0201089 A1 | 7/2016 | Gersbach et al. |
| 2016/0208243 A1 | 7/2016 | Zhang et al. |
| 2016/0280798 A1 | 9/2016 | Orentas et al. |
| 2016/0289674 A1 | 10/2016 | Bancel |
| 2016/0304846 A1 | 10/2016 | Liu et al. |
| 2017/0020922 A1 | 1/2017 | Wagner et al. |
| 2017/0121693 A1 | 5/2017 | Liu et al. |
| 2017/0209492 A1 | 7/2017 | June et al. |
| 2017/0233703 A1 | 8/2017 | Xie et al. |
| 2017/0275648 A1 | 9/2017 | Barrangou et al. |
| 2017/0327804 A9 | 11/2017 | Joung et al. |
| 2018/0037625 A1 | 2/2018 | June et al. |
| 2018/0073012 A1 | 3/2018 | Liu et al. |
| 2018/0118834 A1 | 5/2018 | Brogdon et al. |
| 2018/0127780 A1 | 5/2018 | Liu et al. |
| 2018/0171298 A1 | 6/2018 | Duchateau et al. |
| 2018/0179503 A1 | 6/2018 | Maianti et al. |
| 2018/0216095 A1 | 8/2018 | Thanos et al. |
| 2018/0237787 A1 | 8/2018 | Maianti et al. |
| 2018/0273601 A1 | 9/2018 | Adusumilli et al. |
| 2018/0298421 A1 | 10/2018 | Carpenter et al. |
| 2018/0312825 A1 | 11/2018 | Liu et al. |
| 2018/0312828 A1 | 11/2018 | Liu et al. |
| 2018/0312848 A1 | 11/2018 | Zhao et al. |
| 2018/0320163 A1 | 11/2018 | Koonin et al. |
| 2019/0002875 A1 | 1/2019 | Cheng et al. |
| 2019/0010471 A1 | 1/2019 | Zhang et al. |
| 2019/0010481 A1 | 1/2019 | Joung et al. |
| 2019/0093099 A1 | 3/2019 | Liu et al. |
| 2019/0183932 A1 | 6/2019 | MacKall et al. |
| 2019/0192691 A1 | 6/2019 | Barrett |
| 2019/0225955 A1 | 7/2019 | Liu et al. |
| 2019/0345217 A1 | 11/2019 | Ma et al. |
| 2019/0352369 A1 | 11/2019 | June et al. |
| 2019/0352370 A1 | 11/2019 | Bachmann et al. |
| 2019/0367891 A1 | 12/2019 | Liu et al. |
| 2019/0381154 A1 | 12/2019 | Russell |
| 2019/0389928 A1 | 12/2019 | Posey et al. |
| 2020/0000937 A1 | 1/2020 | DiPersio et al. |
| 2020/0063127 A1 | 2/2020 | Lu et al. |
| 2020/0171135 A1 | 6/2020 | Lanier |
| 2020/0190493 A1 | 6/2020 | Liu et al. |
| 2020/0306304 A1 | 10/2020 | Posey et al. |
| 2020/0308571 A1 | 10/2020 | Joung et al. |
| 2020/0370013 A1 | 11/2020 | Posey et al. |
| 2020/0399619 A1 | 12/2020 | Maianti et al. |
| 2021/0032363 A1 | 2/2021 | Lynn et al. |
| 2021/0032661 A1 | 2/2021 | Powell et al. |
| 2021/0060071 A1 | 3/2021 | Posey et al. |
| 2021/0137979 A1 | 5/2021 | Monje-Deisseroth et al. |
| 2021/0171602 A1 | 6/2021 | MacKall et al. |
| 2021/0230246 A1 | 7/2021 | Posey et al. |
| 2021/0252118 A1 | 8/2021 | Slaymaker et al. |
| 2021/0317440 A1 | 10/2021 | Liu et al. |
| 2021/0371858 A1 | 12/2021 | Evans et al. |
| 2021/0380955 A1 | 12/2021 | Bryson et al. |
| 2022/0047637 A1 | 2/2022 | Lamothe-Dreuzy et al. |
| 2022/0098572 A1 | 3/2022 | Slaymaker et al. |
| 2022/0119785 A1 | 4/2022 | Liu et al. |
| 2022/0127594 A1 | 4/2022 | Gaudelli et al. |
| 2022/0133790 A1 | 5/2022 | Gehrke et al. |
| 2022/0136012 A1 | 5/2022 | Gaudelli et al. |
| 2022/0169998 A1 | 6/2022 | Joung et al. |
| 2022/0170027 A1 | 6/2022 | Gaudelli et al. |
| 2022/0220462 A1 | 7/2022 | Liu et al. |
| 2022/0290115 A1 | 9/2022 | Liu et al. |
| 2022/0290134 A1 | 9/2022 | Jin et al. |
| 2022/0290164 A1 | 9/2022 | Ran et al. |
| 2022/0307003 A1 | 9/2022 | Liu |
| 2022/0387622 A1 | 12/2022 | Gehrke et al. |
| 2023/0021636 A1 | 1/2023 | Gehrke et al. |
| 2023/0075877 A1 | 3/2023 | Gaudelli et al. |
| 2023/0080198 A1 | 3/2023 | Gaudelli et al. |
| 2023/0101597 A1 | 3/2023 | Gaudelli et al. |
| 2023/0108687 A1 | 4/2023 | Liu et al. |
| 2023/0140953 A1 | 5/2023 | Slaymaker et al. |
| 2023/0159956 A1 | 5/2023 | Bryson et al. |
| 2023/0212575 A1 | 7/2023 | Odate et al. |
| 2023/0348883 A1 | 11/2023 | Liu et al. |
| 2023/0383277 A1 | 11/2023 | Cafferty et al. |
| 2023/0407277 A1 | 12/2023 | Joung et al. |
| 2024/0132867 A1 | 4/2024 | Gaudelli et al. |
| 2024/0287453 A1 | 8/2024 | Maldini et al. |
| 2024/0325533 A1 | 10/2024 | Murray et al. |
| 2025/0090585 A1 | 3/2025 | Messana et al. |

FOREIGN PATENT DOCUMENTS

| | | |
|---|---|---|
| CN | 106061510 A | 10/2016 |
| CN | 106103475 A | 11/2016 |
| CN | 106916852 A | 7/2017 |
| CN | 107043779 A | 8/2017 |
| CN | 107075483 A | 8/2017 |
| CN | 107109413 A | 8/2017 |
| CN | 107206024 A | 9/2017 |
| CN | 107249606 A | 10/2017 |
| CN | 107532161 A | 1/2018 |
| CN | 108064282 A | 5/2018 |
| CN | 108290933 A | 7/2018 |
| CN | 108513575 A | 9/2018 |
| CN | 108699116 A | 10/2018 |
| CN | 108753823 A | 11/2018 |
| CN | 108949825 A | 12/2018 |
| CN | 109295186 A | 2/2019 |
| CN | 109328231 A | 2/2019 |
| CN | 109706121 A | 5/2019 |
| CN | 109957569 A | 7/2019 |
| CN | 109996811 A | 7/2019 |
| CN | 110214180 A | 9/2019 |
| CN | 110214183 A | 9/2019 |
| CN | 110268050 A | 9/2019 |
| CN | 110616189 A | 12/2019 |
| EP | 2877490 B1 | 9/2018 |
| EP | 3956349 A1 | 2/2022 |
| JP | 2017500035 A | 1/2017 |
| JP | 2017508468 A | 3/2017 |
| JP | 2018500006 A | 1/2018 |
| JP | 2018536436 A | 12/2018 |

(56) References Cited

FOREIGN PATENT DOCUMENTS

| | | | |
|---|---|---|---|
| JP | 6629734 | A2 | 1/2020 |
| KR | 20160050069 | A | 5/2016 |
| WO | 1997025416 | A2 | 7/1997 |
| WO | 2001038547 | A2 | 5/2001 |
| WO | 2002068676 | A2 | 9/2002 |
| WO | 2002103028 | A2 | 12/2002 |
| WO | 2010132092 | A2 | 11/2010 |
| WO | 2011075627 | A1 | 6/2011 |
| WO | 2013045632 | A1 | 4/2013 |
| WO | 2013126729 | A1 | 8/2013 |
| WO | 2013176772 | A1 | 11/2013 |
| WO | 2013188037 | A2 | 12/2013 |
| WO | 2014004336 | A2 | 1/2014 |
| WO | 2014089290 | A1 | 6/2014 |
| WO | 2014184143 | A1 | 11/2014 |
| WO | 2014184741 | A1 | 11/2014 |
| WO | 2014186686 | A2 | 11/2014 |
| WO | 2015006294 | A2 | 1/2015 |
| WO | 2015006498 | A2 | 1/2015 |
| WO | 2015021426 | A1 | 2/2015 |
| WO | 2015069922 | A2 | 5/2015 |
| WO | 2015089277 | A1 | 6/2015 |
| WO | 2015089406 | A1 | 6/2015 |
| WO | 2015090230 | A1 | 6/2015 |
| WO | 2015092024 | A2 | 6/2015 |
| WO | 2015133554 | A1 | 9/2015 |
| WO | 2015142675 | A2 | 9/2015 |
| WO | 2015191693 | A2 | 12/2015 |
| WO | 2016011210 | A2 | 1/2016 |
| WO | 2016016343 | A1 | 2/2016 |
| WO | 2016019300 | A1 | 2/2016 |
| WO | 2016061368 | A1 | 4/2016 |
| WO | 2016069910 | A1 | 5/2016 |
| WO | 2016072399 | A1 | 5/2016 |
| WO | 2016073649 | A1 | 5/2016 |
| WO | 2016075612 | A1 | 5/2016 |
| WO | 2016094304 | A2 | 6/2016 |
| WO | 2016115482 | A1 | 7/2016 |
| WO | 2016138038 | A1 | 9/2016 |
| WO | 2016142532 | A2 | 9/2016 |
| WO | 2016160721 | A1 | 10/2016 |
| WO | 2016172727 | A1 | 10/2016 |
| WO | 2016183438 | A1 | 11/2016 |
| WO | 2016196308 | A1 | 12/2016 |
| WO | 2016196388 | A1 | 12/2016 |
| WO | 2016205711 | A1 | 12/2016 |
| WO | 2016205759 | A1 | 12/2016 |
| WO | 2017011721 | A1 | 1/2017 |
| WO | 2017048969 | A1 | 3/2017 |
| WO | 2017049166 | A1 | 3/2017 |
| WO | 2017070632 | A2 | 4/2017 |
| WO | 2017070633 | A2 | 4/2017 |
| WO | 2017077386 | A1 | 5/2017 |
| WO | 2017079703 | A1 | 5/2017 |
| WO | 2017079705 | A1 | 5/2017 |
| WO | 2017093804 | A2 | 6/2017 |
| WO | 2017132580 | A2 | 8/2017 |
| WO | 2017152015 | A1 | 9/2017 |
| WO | 2017165862 | A1 | 9/2017 |
| WO | 2017173054 | A1 | 10/2017 |
| WO | 2017180993 | A1 | 10/2017 |
| WO | 2017184768 | A1 | 10/2017 |
| WO | 2017189308 | A1 | 11/2017 |
| WO | 2018009562 | A1 | 1/2018 |
| WO | 2018020323 | A2 | 2/2018 |
| WO | 2018027036 | A1 | 2/2018 |
| WO | 2018027078 | A1 | 2/2018 |
| WO | 2018035388 | A1 | 2/2018 |
| WO | 2018041973 | A1 | 3/2018 |
| WO | 2018071868 | A1 | 4/2018 |
| WO | 2018085690 | A1 | 5/2018 |
| WO | 2018089664 | A1 | 5/2018 |
| WO | 2018115906 | A1 | 6/2018 |
| WO | 2018119354 | A1 | 6/2018 |
| WO | 2018119359 | A1 | 6/2018 |
| WO | 2018129129 | A1 | 7/2018 |
| WO | 2018140725 | A1 | 8/2018 |
| WO | 2018160768 | A1 | 9/2018 |
| WO | 2018165629 | A1 | 9/2018 |
| WO | 2018165631 | A1 | 9/2018 |
| WO | 2018176009 | A1 | 9/2018 |
| WO | 2018183888 | A2 | 10/2018 |
| WO | 2018204427 | A1 | 11/2018 |
| WO | 2018213708 | A1 | 11/2018 |
| WO | 2018213726 | A1 | 11/2018 |
| WO | 2018218066 | A1 | 11/2018 |
| WO | 2018218188 | A2 | 11/2018 |
| WO | 2018231871 | A1 | 12/2018 |
| WO | 2019005884 | A1 | 1/2019 |
| WO | 2019005886 | A1 | 1/2019 |
| WO | 2019014456 | A1 | 1/2019 |
| WO | 2019014665 | A1 | 1/2019 |
| WO | 2019023680 | A1 | 1/2019 |
| WO | 2019040650 | A1 | 2/2019 |
| WO | 2019071274 | A1 | 4/2019 |
| WO | 2019079347 | A1 | 4/2019 |
| WO | 2019118902 | A2 | 6/2019 |
| WO | 2019120310 | A1 | 6/2019 |
| WO | 2019139645 | A2 | 7/2019 |
| WO | 2019161271 | A1 | 8/2019 |
| WO | 2019183000 | A1 | 9/2019 |
| WO | 2019199689 | A1 | 10/2019 |
| WO | 2019210207 | A2 | 10/2019 |
| WO | 2019217941 | A1 | 11/2019 |
| WO | 2019217942 | A1 | 11/2019 |
| WO | 2019217943 | A1 | 11/2019 |
| WO | 2019217944 | A1 | 11/2019 |
| WO | 2019226953 | A1 | 11/2019 |
| WO | 2020010239 | A1 | 1/2020 |
| WO | 2020028823 | A1 | 2/2020 |
| WO | 2020041751 | A1 | 2/2020 |
| WO | 2020051561 | A1 | 3/2020 |
| WO | 2020112870 | A1 | 6/2020 |
| WO | 2020118076 | A1 | 6/2020 |
| WO | 2020132327 | A1 | 6/2020 |
| WO | 2020150534 | A2 | 7/2020 |
| WO | 2020160514 | A1 | 8/2020 |
| WO | 2020160517 | A1 | 8/2020 |
| WO | 2020163396 | A1 | 8/2020 |
| WO | 2020168051 | A1 | 8/2020 |
| WO | 2020168075 | A1 | 8/2020 |
| WO | 2020168088 | A1 | 8/2020 |
| WO | 2020168122 | A1 | 8/2020 |
| WO | 2020168132 | A1 | 8/2020 |
| WO | 2020168133 | A1 | 8/2020 |
| WO | 2020168135 | A1 | 8/2020 |
| WO | 2020168300 | A1 | 8/2020 |
| WO | 2020176897 | A1 | 9/2020 |
| WO | 2020198413 | A1 | 10/2020 |
| WO | 2020214842 | A1 | 10/2020 |
| WO | 2020227446 | A1 | 11/2020 |
| WO | 2020227447 | A1 | 11/2020 |
| WO | 2020236936 | A1 | 11/2020 |
| WO | 2020236964 | A1 | 11/2020 |
| WO | 2020236982 | A1 | 11/2020 |
| WO | 2020243315 | A1 | 12/2020 |
| WO | 2021020884 | A2 | 2/2021 |
| WO | 2021022043 | A2 | 2/2021 |
| WO | 2021041945 | A2 | 3/2021 |
| WO | 2021042062 | A2 | 3/2021 |
| WO | 2021050571 | A1 | 3/2021 |
| WO | 2021055459 | A1 | 3/2021 |
| WO | 2021062227 | A2 | 4/2021 |
| WO | 2021072250 | A1 | 4/2021 |
| WO | 2021081264 | A1 | 4/2021 |
| WO | 2021087182 | A1 | 5/2021 |
| WO | 2021087356 | A1 | 5/2021 |
| WO | 2021097521 | A1 | 5/2021 |
| WO | 2021108717 | A2 | 6/2021 |
| WO | 2021127594 | A1 | 6/2021 |
| WO | 2021158921 | A2 | 8/2021 |
| WO | 2021163616 | A1 | 8/2021 |
| WO | 2021175288 | A1 | 9/2021 |
| WO | 2021207651 | A2 | 10/2021 |

(56) References Cited

FOREIGN PATENT DOCUMENTS

| WO | 2022008935 A1 | 1/2022 |
|---|---|---|
| WO | 2022015969 A1 | 1/2022 |
| WO | 2022056254 A2 | 3/2022 |
| WO | 2022056324 A1 | 3/2022 |
| WO | 2022067089 A1 | 3/2022 |
| WO | 2022081890 A1 | 4/2022 |
| WO | 2022112404 A1 | 6/2022 |
| WO | 2022148955 A1 | 7/2022 |
| WO | 2022150367 A1 | 7/2022 |
| WO | 2022150372 A1 | 7/2022 |
| WO | 2022150706 A2 | 7/2022 |
| WO | 2022204574 A1 | 9/2022 |
| WO | 2022272292 A2 | 12/2022 |
| WO | 2023279118 A2 | 1/2023 |
| WO | 2023288304 A2 | 1/2023 |
| WO | 2023023515 A1 | 2/2023 |
| WO | 2023034959 A2 | 3/2023 |
| WO | 2023047338 A1 | 3/2023 |
| WO | 2023049299 A2 | 3/2023 |
| WO | 2023108107 A2 | 6/2023 |
| WO | 2023125814 A1 | 7/2023 |
| WO | 2023155901 A1 | 8/2023 |
| WO | 2023193536 A1 | 10/2023 |
| WO | 2023227669 A3 | 11/2023 |
| WO | 2023235813 A2 | 12/2023 |
| WO | 2023247753 A1 | 12/2023 |
| WO | 2023248110 A1 | 12/2023 |
| WO | 2024006772 A2 | 1/2024 |
| WO | 2024040083 A1 | 2/2024 |
| WO | 2024044750 A2 | 2/2024 |
| WO | 2024063273 A1 | 3/2024 |
| WO | 2024073385 A2 | 6/2024 |
| WO | 2024179426 A2 | 9/2024 |
| WO | 2024226156 A1 | 10/2024 |
| WO | 2024227047 A2 | 10/2024 |
| WO | 2024259364 A2 | 12/2024 |

OTHER PUBLICATIONS

U.S. Appl. No. 14/325,815, filed Jul. 6, 2021, Liu et al.

Addgene Plasmid No. 44246, Create Date Feb. 28, 2013.

Addgene Plasmid No. 73021, Create Date Apr. 20, 2016.

Addgene Plasmid No. 79620, Create Date Aug. 4, 2016.

Alexandrov et al., "Signatures of mutational processes in human cancer," Nature, Aug. 22, 2013, vol. 500, pp. 415-421.

Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.

Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.

Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.

Branden and Tooze, "The Building Blocks," Introduction to Protein Structure, 1999, vol. 2, pp. 3-12.

Briner et al., "Guide RNA Functional Modules Direct Cas9 Activity and Orthogonality," Molecular Cell, Oct. 23, 2014, vol. 56, pp. 333-339.

Bulow et al., "Multienzyme systems obtained by gene fusion," Trends in Biotechnology, Jan. 1991, vol. 9, pp. 226-231.

Cameron, Ewan R., "Recent Advances in Transgenic Technology," Molecular Biotechnology, 1997, vol. 7, pp. 253-265.

Chatterjee et al., "A Cas9 with PAM recognition for adenine dinucleotides," Nature Communications, 2020, vol. 11, No. 2474, pp. 1-6.

Chester et al., "The apolipoprotein B mRNA editing complex performs a multifunctional cycle and suppresses honsense-mediated decay," The EMBO Journal, 2003, vol. 22, No. 15, pp. 3971-3982.

Chichili et al., "Linkers in the structural biology of protein-protein interactions," Protein Science, 2013, vol. 22, pp. 153-167.

Chylinski et al., "The tracrRNA and Cas9 families of type II CRISPR-Cas immunity systems," RNA Biology, May 2013, vol. 10, No. 5, pp. 726-737.

Collantes et al., "Development and Characterization of a Modular CRISPR and RNA Aptamer Mediated Base Editing System," The CRISPR Journal, 2021, vol. 4, No. 1, pp. 58-68.

Cong et al., "Multiplex Genome Engineering Using CRISPR/Cas Systems," Science, Feb. 15, 2013, vol. 339, No. 6121, pp. 819-823.

Dai et al., "Bispecific CAR-T cells targeting both CD19 and CD22 for therapy of adults with relapsed or refractory B cell acute lymphoblastic leukemia," Journal of Hematology & Oncology, 2020, vol. 13, No. 30, pp. 1-11.

Deltcheva et al., "CRISPR RNA maturation by trans-encoded small RNA and host factor RNase III," Nature, Mar. 31, 2011, vol. 471, pp. 602-607.

Depil et al., "'Off-the-shelf' allogeneic CAR T cells: development and challenges," Nature Reviews Drug Discovery, 2020, pp. 1-15.

Endo et al., "Toward establishing an efficient and versatile gene targeting system in higher plants," Biocatalysis and Agricultural Biotechnology, 2014, vol. 3, pp. 2-6.

Ferretti et al., "Complete genome sequence of an M1 strain of Streptococcus pyogenes," Proceedings of the National Academy of Sciences of the United States of America, Apr. 10, 2001, vol. 98, No. 8, pp. 4658-4663.

Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.

Freshney et al., "Culture of Animal Cells, A Manual of Basic Technique," Food and Chemical Toxicology, 1983, vol. 23, No. 3, pp. 403-404.

Fu et al., "Human cell based directed evolution of adenine base editors with improved efficiency," Nature Communications, 2021, vol. 12, No. 5897, pp. 1-11.

Gardlik et al., "Vectors and delivery systems in gene therapy," Medical Science Monitor, 2005, vol. 11, No. 4, pp. RA110-RA121.

Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.

Gasiunas et al., "RNA-dependent DNA endonuclease Cas9 of the CRISPR system: Holy Grail of genome editing?" Trends in Microbiology, Nov. 2013, vol. 21, No. 11, pp. 562-567.

Gaudelli et al., "Directed evolution of adenine base editors with increased activity and therapeutic application," Nature Biotechnology, 2020, pp. 1-15.

Gaudelli et al., "Programmable base editing of A•T to G•C in genomic DNA without DNA cleavage," Nature, Nov. 23, 2017, vol. 551, pp. 464-471.

Grunewald et al., "CRISPR DNA base editors with reduced RNA off-target and self-editing activities," Nature Biotechnology, Sep. 2019, vol. 37, No. 9, pp. 1041-1048.

Grunewald et al., "Transcriptome-wide off-target RNA editing induced by CRISPR-guided DNA base editors," Nature, May 2019, vol. 569, No. 7756, pp. 433-437.

Guilinger et al., "Fusion of catalytically inactive Cas9 to FokI nuclease improves the specificity of genome modification," Nature Biotechnology, 2014, pp. 1-6.

Guo et al., "Protein tolerance to random amino acid change," Proceedings of the National Academy of Sciences of the United States of America, Jun. 22, 2004, vol. 101, No. 25, pp. 9205-9210.

Hill et al., "Functional Analysis of Conserved Histidines in ADP-Glucose Pyrophosphorylase from Escherichia coli," Biochemical Biophysical Research Communications, 1998, vol. 244, No. 2, pp. 573-577.

Houdebine, Louis-Marie, "The methods to generate transgenic animals and to control transgene expression," Journal of Biotechnology, 2002, vol. 98, pp. 145-160.

Hu et al., "Evolved Cas9 variants with broad PAM compatibility and high DNA specificity," Nature, Apr. 5, 2018, vol. 556, pp. 57-63.

(56) References Cited

OTHER PUBLICATIONS

Hua et al., "Expanding the base editing scope in rice by using Cas9 variants," Plant Biotechnology Journal, 2019, vol. 17, pp. 499-504.
Huang et al., "Circularly permuted and PAM-modified Cas9 variants broaden the targeting scope of base editors," Nature Biotechnology, Jun. 2019, vol. 37, No. 6, pp. 626-631.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.
Jiang et al., "Chemical modifications of adenine base editor mRNA and guide RNA expand its application scope," Nature Communications, 2020, vol. 11, No. 1979, pp. 1-9.
Jin et al., "Cytosine, but not adenine, base editors induce genome-wide off-target mutations in rice," Science, Apr. 19, 2019, vol. 364, pp. 292-295.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
June et al., "Chimeric Antigen Receptor Therapy," The New England Journal of Medicine, Jul. 5, 2018, vol. 379, No. 1, pp. 64-73.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.
Azad et al., "Site-directed RNA editing by adenosine deaminase acting on RNA for correction of the genetic code in gene therapy," Gene Therapy, 2017, vol. 24, pp. 779-786.
Baligar et al., "Bone Marrow Stem Cell Therapy Partially Ameliorates Pathological Consequences in Livers of Mice Expressing Mutant Human α1-Antitrypsin," Hepatology, Apr. 2017, vol. 65, No. 4, pp. 1319-1335.
Bjursell et al., "Therapeutic Genome Editing With CRISPR/Cas9 in a Humanized Mouse Model Ameliorates α1-antitrypsin Deficiency Phenotype," EBioMedicine, 2018, vol. 29, pp. 104-111.
Canver et al., "Customizing the genome as therapy for the B-hemoglobinopathies," Blood, May 26, 2016, vol. 127, No. 21, pp. 2536-2545.
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Article No. 9, pp. 1741-1747.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.
GenBank Locus No. LC169509.1, downloaded Aug. 10, 2023.
GenBank NCBI Reference Sequence No. NM_000295.4, downloaded Aug. 23, 2023.
Greene et al., "Alpha-1 Antitrypsin Deficiency: Recent Developments in Gene Therapy Research," Gene Therapy Application, 2011, vol. 25, pp. 449-460.
Hess et al., "Methods and Applications of CRISPR-Mediated Base Editing in Eukaryotic Genomes," Molecular Cell, Oct. 5, 2017, vol. 68, pp. 26-43.

Jha et al., "Single amino acid substitutions in recombinant plant-derived human α1-proteinase inhibitor confer enhanced stability and functional efficacy," Biochimica et Biophysica Acta, 2014, vol. 1840, pp. 416-427.
Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 7-15 containing Online Methods, Supplementary Material, Acknowledgments, References and Figures (15 total pages).
Kleinstiver et al., "Broadening the targeting range of Staphylococcus aureus CRISPR-Cas9 by modifying PAM recognition," Nature Biotechnology, Dec. 2015, vol. 33, No. 12, pp. 1293-1298 and p. 1299 containing Online Methods (7 total pages).
Lei et al., "Glucose-6-phosphatase dependent substrate transport in the glycogen storage disease type-1a mouse," Nature Genetics, Jun. 1996, vol. 13, pp. 203-209.
Musallam et al., "Fetal hemoglobin levels and morbidity in untransfused patients with β-thalassemia intermedia," Blood, Jan. 12, 2012, vol. 119, No. 2, pp. 364-367.
NCBI Reference Sequence No. NP_000286.3, downloaded Sep. 27, 2023.
Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.
Pournasr et al., "Modeling Inborn Errors of Hepatic Metabolism Using Induced Pluripotent Stem Cells," Arteriosclerosis, Thrombosis, and Vascular Biology, Nov. 2017, vol. 37, pp. 1994-1999.
Qianqian, Xiong, "Advances in Diagnosis and Treatment of Glycogen Storage Diseases," Journal of Stroke and Neurological Diseases, 2017, vol. 34, No. 10, pp. 957-960 [English Abstract].
Qing et al., "Research progress on double-stranded RNA-specific adenosine deaminase-DSRAD/ADAR1," Foreign Medical Sciences, 2004, vol. 3, pp. 129-132 [English Abstract Only].
Rajamohan et al., "Current status of drug screening and disease modelling in human pluripotent stem cells," Bioessays, 2012, vol. 35, pp. 281-298.
Ryu et al., "Adenine base editing in mouse embryos and an adult mouse model of Duchenne muscular dystrophy," Nature Biotechnology, Jun. 2018, vol. 36, No. 6, pp. 536-539.
Sangkitporn et al., "Hb G Makassar (Beta 6: Glu-→ Ala) in a Thai Family," Journal of the Medical Association of Thailand, May 2002, vol. 85, No. 5, pp. 577-582.
Shah et al., "Efficient and versatile CRISPR engineering of human neurons in culture to model neurological disorders," Wellcome Open Research, Nov. 15, 2016, vol. 1, No. 13, pp. 1-18 and pp. 19-21 containing Open Peer Review (21 total pages).
Shah et al., "MeCP2 mutations: progress towards understanding and treating Rett syndrome," Genome Medicine, 2017, vol. 9, No. 17, pp. 1-4.
Shen et al., "Amelioration of Alpha-1 Antitrypsin Deficiency Diseases with Genome Editing in Transgenic Mice," Human Gene Therapy, 2018, vol. 29, No. 8, pp. 861-873.
Sinnamon et al., "Site-directed RNA repair of endogenous Mecp2 RNA in neurons," Proceedings of the National Academy of Sciences of the United States of America, Oct. 16, 2017, pp. E9395-E9402.
Smith et al., "Efficient and Allele-Specific Genome Editing of Disease Loci in Human iPSCs," Molecular Therapy, Mar. 2015, vol. 23, No. 3, pp. 570-577.
Valdmanis et al., "Future of rAAV Gene Therapy: Platform for RNAi, Gene Editing, and Beyond," Human Gene Therapy, 2017, vol. 28, No. 4, pp. 361-372.
Wei et al., "The "new favorite" of gene editing technology-single base editors," Hereditas, 2017, vol. 39, No. 12, pp. 1115-1121 [English Abstract].
Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.
Wienert et al., "KLF1 drives the expression of fetal hemoglobin in British HPFH," Blood, Aug. 10, 2017, vol. 130, No. 6, pp. 803-807.

(56)          References Cited

OTHER PUBLICATIONS

Yuliang et al., "Diagnosis and treatment of α1-antitrypsin defi-ciency," Practical Clinical Medicine, 2017, vol. 2, pp. 104-107 [English Abstract Only].

Baños-Sanz et al., "Crystal structure and functional insights into uracil-DNA glycosylase inhibition by phage φ29 DNA mimic protein p56," Nucleic Acids Research, 2013, vol. 41, No. 13, pp. 6761-6773.

Bc021560, European Nucleotide Archive Accession No. BC021560, *Homo sapiens* deleted in bladder cancer 1, mRNA (cDNA clone), complete eds., Jan. 22, 2002 [online]. [Retrieved on Oct. 2, 2023]. Retrieved from the Internet <URL: https://www.ebi.ac.uk/ena/browser/view/BC021560> Entire document.

Charpentier et al. "Rewriting a genome", Nature, Mar. 2013, vol. 495, No. 7439, pp. 50-51.

Chen et al. "Targeting genomic rearrangements in tumor cells through Cas9-mediated insertion of a suicide gene." Nature Bio-technology, Jun. 2017, vol. 35, No. 6, pp. 543-552.

Cooper et al., "An "off-the-shelf" fratricide-resistant CAR-T for the treatment of T cell hematologic malignancies", Blood Cancer Journal, vol. 32, No. 9, Feb. 20, 2018, pp. 1970-1983.

Cooper et al., "Chimeric antigen 1-5 receptor T cells (CAR-T) for the treatment of T-cell malignancies", Best Practice & Research Clinical Haematology, vol. 32, No. 4, Oct. 2019.

De Souza. "Primer: genome editing with engineered nucleases." Nature Methods, vol. 9, No. 1, Jan. 2012, pp. 27-27.

Edwards Aaron et al: "Base Editors Generate Allogeneic CAR-T Cells with No Detectable Genomic Rearrangements and Reduced Genotoxicity", Molecular Therapy; 22nd Annual Meeting of the American-Society-of-Gene-and-Cell-Therapy (ASGCT), Apr. 29-May 2, 2019, vol. 27, No. 4, Suppl. 1, Apr. 22, 2019, p. 74.

Gao et al. Inflammation negatively regulates FOXP3 and regulatory T-cell function via DBC1. Proceedings of the National Academy of Sciences of the United States of America, Jun. 9, 2015, vol. 112, No. 25, E3246-E3254.

Gaudelli et al., "Programmable Base Editing of A•T to G•C in Genomic DNA without DNA Cleavage," Nature, Nov. 23, 2017, vol. 551, pp. 464-471 and pp. 472-487 containing Methods, Figures, Life Sciences Reporting Summary and Corrections & Amendments (37 total pages).

GenBank Accession No. CTS26096.1, downloaded Apr. 9, 2024.

Geneseq, "*Streptococcus pyogenes* Cas9 protein", XP002808136, retrieved from EBI accession No. GSP: BIR 16744 Database accession No. BIR16744 sequence -& DATBSE Geneseq [Online], Jan. 21, 2021.

Geneseq, "*Streptococcus pyogenes* Cas9 protein", XP002808135, retrieved from EBI accession No. GSP: BIR16747 Database acces-sion No. BIR16747 sequence -& DATBSE Geneseq [Online], Jan. 21, 2021.

Geneseq, "Adenine deaminase polypeptide SEQ: 49.", XP002808137, retrieved from EBI accession No. GSP: BJG44493 Database acces-sion No. BJG44493 sequence -& DATBSE Geneseq [Online], Jun. 10, 2021.

Grimm et al., In vitro and In vivo Gene Therapy Vector Evolution via Multispecies Interbreeding and Retargeting of Adeno-Associated Viruses. J. Virol., 2008, vol. 82, p. 5887-5911.

Jeong et al., "Measurement of deoxyinosine adduct: Can it be a reliable tool to assess oxidative or nitrosative DNA damage?," Toxicology Letters, 2012, vol. 214, pp. 226-233.

Kim et al., "Highly efficient RNA-guided base editing in mouse embryos," Nature Biotechnology, 2017, pp. 1-4.

Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).

Komor et al., "Programmable Editing of a Target Base in Genomic DNA without Double-Stranded DNA Cleavage," Nature, May 19, 2016, vol. 533, pp. 420-424 and pp. 425-436 containing Methods and Figures (25 total pages).

Li et al. "Base editing with a Cpf1-cytidine deaminase fusion." Nature biotechnology, 2018, vol. 36, No. 4, pp. 324-327.

Liu et al., "Research Progress of Base Editing System," World Sci-Tech R&D, Dec. 2017, vol. 39, No. 6, pp. 457-462 [English Abstract].

Liu, et al. "Crossing the blood-brain barrier with AAV vectors," Metabolic Brain Disease, 2021, vol. 36, pp. 45-52.

Maeder et al. "CRISPR RNA-guided activation of endogenous human genes", Nature Methods, Oct. 2013, vol. 10, No. 10, pp. 977-979.

Mariani et al. "Species-specific exclusion of APOBEC3G from HIV-1 virions by Vif." Cell, 2003, vol. 114, No. 1, 21-31.

NCBI Reference Protein No. Q694B3.2, downloaded Apr. 8, 2024.

NCBI Reference Sequence No. WP_032188360.1, downloaded Apr. 9, 2024.

Newby et al. "Base editing of haematopoietic stem cells rescues sickle cell disease in mice", Nature, Nature Publishing Group UK, London, 2021, vol. 595, Article No. 7866, pp. 295-302, p. 296; Figure 1, p. 301.

O'Connell et al., Programmable RNA recognition and cleavage by CRISPR/Cas9. Nature, 2014, vol. 516, p. 263-266.

Pattanayak et al., "High-throughput profiling of off-target DNA cleavage reveals RNA-programmed Cas9 nuclease specificity," Nature Biotechnology, Sep. 2013, vol. 31, No. 9, pp. 839-843.

Qasim, "Allogeneic CART cell therapies for leukemia", American Journal of Hematology, vol. 94, Feb. 1, 2019, pp. S50-S54.

Ranzau et al., "The wild-type tRNA adenosine deaminase enzyme TadA is capable of sequence-specific DNA base editing." Chembiochem, Aug. 2023, vol. 24, No. 16, pp. 1-35.

Riesenberg et al. "Improved gRNA secondary structures allow editing of target sites resistant to CRISPR-Cas9 cleavage." Nature communications, 2022, vol. 13 No. 1, p. 489.

Rogozin et al. "Evolution and diversification of lamprey antigen receptors: evidence for involvement of an AID-APOBEC family cytosine deaminase," Nature Immunology, Jun. 2007, vol. 8, No. 6, pp. 647-656.

Rölle et al., "Distinct HLA-E Peptide Complexes Modify Antibody-Driven Effector Functions of Adaptive NK Cells," Cell Reports, Aug. 2018, vol. 24, No. 8, pp. 1967-1976.

Ruffolo, et al., "Design of highly functional genome editors by modeling of the universe of CRISPR-Cas Sequences," bioRxiv, posted Apr. 22, 2024, doi: 10.1101/2024.04.22.590591.

Song et al. "Delivery of CRISPR/Cas systems for cancer gene therapy and immunotherapy." Advanced Drug Delivery Reviews, 2021, vol. 168, pp. 150-180.

Stanton et al. "Systemic administration of novel engineered AAV capsids facilitates enhanced transgene expression in the macaque CNS." Med, 2023, vol. 4. no. 1, pp. 31-50.

Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.

Tipanee, et al. "Transposons: Moving Forward from Preclinical Studies to Clinical Trials," Human Gene Therapy, Nov. 2017, pp. 1087-1104.

Tsai et al. "Dimeric CRISPR RNA-guided FokI nucleases for highly specific genome editing." Nature Biotechnology, Apr. 2014, vol. 32, No. 6, pp. 569-576.

UniProt Accession No. Q6JC40, Downloaded Nov. 14, 2024.

Wan et al. "Material solutions for delivery of CRISPR/Cas-based genome editing tools: current status and future outlook." Materials Today, Jun. 2019, vol. 26, pp. 40-66.

Yu et al., "Cutting Edge: Single-Chain Trimers of MHC Class I Molecules Form Stable Structures That Potently Stimulate Antigen-Specific T Cells and B Cells," The Journal of Immunology, 2002, vol. 168, pp. 3145-3149.

Zhou et al., "Cas12a variants designed for lower genome-wide off-target effect through stringent PAM recognition", Molecular Therapy, Jan. 2022, vol. 30, No. 1 , pp. 1-12.

Ren et al., "Multiplex Genome Editing to Generate Universal CAR T Cells Resistant to PD1 Inhibition," Clinical Cancer Research, May 1, 2017, vol. 23, No. 9, pp. 2255-2266.

(56) References Cited

OTHER PUBLICATIONS

Richter et al., "Phage-assisted evolution of an adenine base editor with improved Cas domain compatibility and activity," Nature Biotechnology, Jul. 2020, vol. 38, No. 7, pp. 883-891.
Sang, Helen, "Prospects for transgenesis in the chick," Mechanisms of Development, 2004, vol. 121, pp. 1179-1186.
Serreze et al., "Major Histocompatibility Complex Class I-Deficient NOD-B2mnull Mice are Diabetes and Insulitis Resistant," Diabetes, Mar. 1994, vol. 43, pp. 505-509.
Shimomura et al., "Complete genome sequencing and analysis of a Lancefield group G *Streptococcus dysgalactiae* subsp. equisimilis strain causing streptococcal toxic shock syndrome (STSS), " BMC Genomics, 2011, vol. 12, No. 17, pp. 1-17.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Stadtmauer et al., "First-in-Human Assessment of Feasibility and Safety of Multiplexed Genetic Engineering of Autologous T Cells Expressing NY-ESO-1 TCR and CRISPR/Cas9 Gene Edited to Eliminate Endogenous TCR and PD-1 (NYCE T cells) in Advanced Multiple Myeloma (MM) and Sarcoma," Blood, 2019, vol. 134, No. 49, Supplement 1, pp. 1-4.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
Themeli et al., "New Cell Sources for T Cell Engineering and Adoptive Immunotherapy," Cell Stem Cell, Apr. 2, 2015, vol. 16, pp. 357-366.
Tsai et al., "GUIDE-seq enables genome-wide profiling of off-target cleavage by CRISPR-Cas nucleases," Nature Biotechnology, Feb. 2015, vol. 33, No. 2, pp. 187-197.
UniProt Accession No. P01011, Create Date Jul. 21, 1986.
UniProt Accession No. Q99ZW2, Create Date Jul. 11, 2012.
UniProt Proteome ID No. UP000009215, Create Date May 2012.
Wacey et al., "Disentangling the perturbational effects of amino acid substitutions in the DNA-binding domain of p53," Human Genetics, 1999, vol. 104, pp. 15-22.
Walton et al., "Unconstrained genome targeting with near-PAMless engineered CRISPR-Cas9 variants," Science, Mar. 26, 2020, pp. 1-11.
Wang et al., "Enhanced base editing by co-expression of free uracil DNA glycosylase inhibitor," Cell research, Oct. 2017, vol. 27, No. 10, pp. 1289-1292.
Wang et al., "Eliminating base-editor-induced genome-wide and transcriptome-wide off-target mutations," Nature Cell Biology, 2021, pp. 1-32.
Webber et al., "Highly efficient multiplex human T cell engineering without double-strand breaks using Cas9 base editors," Nature Communications, 2019, vol. 10, No. 5222, pp. 1-10.
Wijesinghe et al., "Efficient deamination of 5-methylcytosines in DNA by human APOBEC3A, but not by AID or APOBEC3G," Nucleic Acids Research, Jul. 13, 2012, vol. 40, No. 18, pp. 9206-9217.
Wolf et al., "tadA, an essential tRNA-specific adenosine deaminase from *Escherichia coli*," The EMBO Journal, 2002, vol. 21, No. 14, pp. 3841-3851.
Xu et al., "Mechanisms of Relapse After CD19 CAR T-Cell Therapy for Acute Lymphoblastic Leukemia and Its Prevention and Treatment Strategies," Frontiers in Immunology, Nov. 2019, vol. 10, No. 2664, pp. 1-15.

Yan et al., "Functionally diverse type V CRISPR-Cas systems," Science, Jan. 4, 2019, vol. 363, pp. 88-91.
Yang et al., "Engineering and optimising deaminase fusions for genome editing," Nature Communications, 2016, vol. 7, No. 13330, pp. 1-11.
Yang et al., "Increasing targeting scope of adenosine base editors in mouse and rat embryos through fusion of TadA deaminase with Cas9 variants," Protein & Cell, 2018, vol. 9, No. 9, pp. 814-819.
Yang et al., "PAM-Dependent Target DNA Recognition and Cleavage by C2c1 CRISPR-Cas Endonuclease," Cell, Dec. 15, 2016, vol. 167, pp. 1814-1828.
Yeh et al., "In vivo base editing of post-mitotic sensory cells," Nature Communications, 2018, vol. 9, No. 2184, pp. 1-10.
Yu et al., "Cytosine base editors with minimized unguided DNA and RNA off-target events and high on-target activity," Nature Communications, 2020, vol. 11, No. 2052, pp. 1-10.
Zafra et al., "Optimized base editors enable efficient editing in cells, organoids and mice," Nature Biotechnology, 2018, pp. 1-6.
Zheng et al., "DNA Editing in DNA/RNA Hybrids by Adenosine Deaminases That Act on RNA," Nucleic Acids Research, 2017, vol. 45, No. 6, pp. 3369-3377.
Zhou et al., "Atypical behaviour and connectivity in SHANK3-mutant macaques," Nature, Jun. 20, 2019, vol. 570, pp. 326-331.
Zhou et al., "Off-target RNA mutation induced by DNA base editing and its elimination by mutagenesis," Nature, Jul. 11, 2019, vol. 571, pp. 275-277.
Zuo et al., "Cytosine base editor generates substantial off-target singlenucleotide variants in mouse embryos," Science, vol. Apr. 19, 2019, vol. 364, No. 6437, pp. 289-292.
Zuris et al., "Efficient Delivery of Genome-Editing Proteins In Vitro and In Vivo," Nature Biotechnology, Jan. 2015, vol. 33, No. 1, pp. 73-80.
International Search Report and Written Opinion dated Jun. 12, 2020 in corresponding International Patent Application No. PCT/2020/018178 (11 pages).
Kim et al., "Highly efficient RNA-guided genome editing in human cells via delivery of purified Cas9 ribonucleoproteins," Genome Research, 2014, vol. 24, pp. 1012-1019.
Kim et al., "Rescue of high-specificity Cas9 variants using sgRNAs with matched 5' nucleotides," Genome Biology, 2017, vol. 18, No. 218, pp. 1-6.
Kim et al., "Transcriptional Repression by Zinc Finger Peptides," The Journal of Biological Chemistry, Nov. 21, 1997, vol. 272, No. 47, pp. 29795-29800.
Kim et al., "Structural and Kinetic Characterization of *Escherichia Coli* TadA, the Wobble-Specific TRNA Deaminase," Biochemistry, 2006, vol. 45, No. 20, pp. 6407-6416.
Kitamura et al., "Uracil DNA Glycosylase Counteracts APOBEC3G-Induced Hypermutation of Hepatitis B Viral Genomes: Excision Repair of Covalently Closed Circular DNA," PLOS Pathogens, May 2013, vol. 9, No. 5, e1003361, pp. 1-14.
Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.
Kleinstiver et al., "Engineered CRISPR-Cas9 nucleases with altered PAM specificities," Nature, Jul. 23, 2015, vol. 523, pp. 481-485.
Kleinstiver et al., "High-fidelity CRISPR-Cas9 variants with undetectable genome-wide off-targets," Molecular Therapy, Jan. 28, 2016, vol. 529, No. 75187, pp. 490-495.
Koblan et al., "Improving cytidine and adenine base editors by expression optimization and ancestral reconstruction," Nature Biotechnology, 2018, pp. 1-4.
Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.
Komor et al., "Programmable editing of a target base in genomic DNA without double-stranded DNA cleavage," Nature, May 19, 2016, vol. 533, pp. 420-424.
Kundu et al., "Leucine to proline substitution by SNP at position 197 in Caspase-9 gene expression leads to neuroblastoma: a bioinformatics analysis," 3 Biotech, 2013, vol. 3, pp. 225-234.

(56)                    References Cited

OTHER PUBLICATIONS

Lapinaite et al., "DNA capture by a CRISPR-Cas9-guided adenine base editor," Science, Jul. 31, 2020, vol. 369, No. 6503, pp. 566-571.

Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.

Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.

Lee et al., "CRISPR-Pass: Gene Rescue of Nonsense Mutations Using Adenine Base Editors," Molecular Therapy, Aug. 2019, vol. 27, No. 8, pp. 1364-1371.

Lee et al., "Cytosine but not adenine base editor generates mutations in mice," bioRxiv, 2019, pp. 1-24.

Lee et al., "PIK3CA gene is frequently mutated in breast carcinomas and hepatocellular carcinomas," Oncogene, 2005, vol. 24, pp. 1477-1480.

Leibundgut-Landmann et al., "Mini-review: Specificity and expression of CIITA, the master regulator of MHC class II genes," European Journal of Immunology, 2004, vol. 34, pp. 1513-1525.

Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.

Li et al., "Current Approaches for Engineering Proteins with Diverse Biological Properties," Bio-Applications of Nanoparticles, 2007, pp. 1-16.

Liu et al., "C2c1-sgRNA Complex Structure Reveals RNA-Guided DNA Cleavage Mechanism," Molecular Cell, Jan. 19, 2017, vol. 65, pp. 310-322.

Lyons et al., "Efficient Recognition of an Unpaired Lesion by a DNA Repair Glycosylase," Journal of the American Chemical Society, 2009, vol. 131, No. 49, pp. 17742-17743.

Ma et al., "Targeted AID-mediated mutagenesis (TAM) enables efficient genomic diversification in mammalian cells," Nature Methods, Dec. 2016, vol. 13, No. 12, pp. 1029-1035.

Majzner et al., "Tumor Antigen Escape from CAR T-cell Therapy," Cancer Discovery, Oct. 2018, vol. 8, No. 10, pp. 1219-1226.

Makarova et al., "Classification and Nomenclature of CRISPR-Cas Systems: Where from Here?," The CRISPR Journal, 2018, vol. 1, No. 5, pp. 325-336.

Mali et al., "Cas9 as a versatile tool for engineering biology," Nature Methods, Oct. 2013, vol. 10, No. 10, pp. 957-963.

Mali et al., "CAS9 transcriptional activators for target specificity screening and paired nickases for cooperative genome engineering," Nature Biotechnology, 2013, pp. 1-6.

Mccann et al., "MagnEdit—interacting factors that recruit DNA-editing enzymes to single base targets," Life Science Alliance, 2020, vol. 3, No. 4, e201900606, pp. 1-9.

Mejstrikova et al., "CD19-negative relapse of pediatric B-cell precursor acute lymphoblastic leukemia following plinatumomab treatment," Blood Cancer Journal, 2017, vol. 7, No. 659, pp. 1-5.

Mikami et al., "Comparison of CRISPR/Cas9 expression constructs for efficient targeted mutagenesis in rice," Plant Molecular Biology, 2015, vol. 88, pp. 561-572.

Miller et al., "Continuous evolution of SpCas9 variants compatible with non-G PAMs," Nature Biotechnology, Apr. 2020, vol. 38, No. 4, pp. 471-481.

Mohamad et al., "Human hemoglobin G-Makassar variant masquerading as sickle cell anemia," Hematology Reports, 2018, vol. 10, No. 7210, pp. 92-95.

Mullins et al., "Transgenesis in Nonmurine Species," Hypertension, Oct. 1993, vol. 22, No. 4, pp. 630-633.

Navaratnam et al., "An Overview of Cytidine Deaminases," International Journal of Hematology, 2006, vol. 83, pp. 195-200.

Nishida et al., "Targeted nucleotide editing using hybrid prokaryotic and vertebrate adaptive immune systems," Science, Sep. 16, 2016, vol. 353, No. 6305, pp. 1248-aaf8729-8.

Nishimasu et al., "Engineered CRISPR-Cas9 nuclease with expanded targeting space," Science, 2018, vol. 361, pp. 1259-1262.

Okumura et al., "Evolutionary paths of streptococcal and staphylococcal superantigens," BMC Genomics, 2012, vol. 13, No. 404, pp. 1-16.

Parr et al., "N1-Methylpseudouridine substitution enhances the performance of synthetic mRNA switches in cells," Nucleic Acids Research, 2020, vol. 48, No. 6, e35, pp. 1-9.

Pausch et al., "CRISPR-CasΦfrom huge phages is a hypercompact genome editor," Science, Jul. 17, 2020, vol. 369, No. 6501, pp. 333-337.

Phillips, Anthony J., "The challenge of gene therapy and DNA delivery," Journal of Pharmacy and Pharmacology, 2001, vol. 53, pp. 1169-1174.

Poirot et al., "Multiplex Genome-Edited T-cell Manufacturing Platform for "Off-the-Shelf" Adoptive T-cell Immunotherapies," Cancer Research, Sep. 15, 2015, vol. 75, No. 18. pp. 3853-3864.

Poller et al., "A Leucine-to-Proline Substitution Causes a Defective α-Antichymotrypsin Allele Associated with Familial Obstructive Lung Disease," Genomics, 1993, vol. 17, pp. 740-743.

Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.

Qasim et al., "Molecular remission of infant B-ALL after infusion of universal TALEN gene-edited CAR T cells," Science Translational Medicine, Jan. 25, 2017, vol. 9, No. eaaj2013, pp. 1-8.

Qi et al., "Repurposing CRISPR as an RNA-Guided Platform for Sequence-Specific Control of Gene Expression," Cell, Feb. 28, 2013, vol. 152, pp. 1173-1183.

Ran et al., "In vivo genome editing using *Staphylococcus aureus* Cas9," Nature, Apr. 9, 2015, vol. 520, No. 7546, pp. 186-191.

Rees et al., "Analysis and minimization of cellular RNA editing by DNA adenine base editors, " Science Advances, May 8, 2019, vol. 5, No. eaax5717, pp. 1-10.

Rees et al., "Base editing: precision chemistry on the genome and transcriptome of living cells," Nature Reviews Genetics, Dec. 2018, vol. 19, No. 12, pp. 770-788.

Rees et al., "Improving the DNA specificity and applicability of base editing through protein engineering and protein delivery," Nature Communications, 2017, vol. 8, No. 15790, pp. 1-10.

Cartegni et al., "Determinants of Exon 7 Splicing in the Spinal Muscular Atrophy Genes, SMN1 and SMN2," The American Journal of Human Genetics, Jan. 2006, vol. 78, pp. 63-77.

Chang et al., "Degradation of survival motor neuron (SMN) protein is mediated via the ubiquitin/proteasome pathway," Neurochemistry International, 2004, vol. 45, pp. 1107-1112.

Cho et al., "A degron created by SMN2 exon 7 skipping is a principal contributor to spinal muscular atrophy severity," Genes & Development, 2010, vol. 24, pp. 438-442.

Corcia et al., "The importance of the SMN genes in the genetics of sporadic ALS," Amyotrophic Lateral Sclerosis, 2009, vol. 10, pp. 436-440.

Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).

Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.

Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).

D'Ydewalle et al., "The Antisense Transcript SMN-AS1 Regulates SMN Expression and is a Novel Therapeutic Target for Spinal Muscular Atrophy," Neuron, Jan. 4, 2017, vol. 93, pp. 63-79.

Fagagna et al., "The Gam protein of bacteriophage Mu is an orthologue of eukaryotic Ku," EMBO reports, 2003, vol. 4, No. 1, pp. 47-52.

GenBank Accession No. AIT42264.1, downloaded Jan. 9, 2024.

GenBank Accession No. AKA60242.1, downloaded Jan. 9, 2024.

GenBank Accession No. AKQ21048.1, downloaded Jan. 9, 2024.

(56)　　　　References Cited

OTHER PUBLICATIONS

GenBank Accession No. AKS40380.1, downloaded Jan. 9, 2024.
GenBank Protein No. 4UN5_B, downloaded Jan. 9, 2024.
Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).
Le et al., "SMND7, the major product of the centromeric survival motor neuron (SMN2 ) gene, extends survival in mice with spinal muscular atrophy and associates with full-length SMN," Human Molecular Genetics, 2005, vol. 14, No. 6, pp. 845-857.
Lefebvre et al., "Identification and Characterization of a Spinal Muscular Atrophy-Determining Gene," Jan. 13, 1995, vol. 80, pp. 155-165.
Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].
Lorson et al., "A single nucleotide in the SMN gene regulates splicing and is responsible for spinal muscular atrophy," Proceedings of the National Academy of Sciences of the United States of America, May 1999, vol. 96, pp. 6307-6311.
Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.
Monani et al., "A single nucleotide difference that alters splicing patterns distinguishes the SMA gene SMN1 from the copy gene SMN2," Human Molecular Genetics, 1999, vol. 8, No. 7, pp. 1177-1183.
Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.
NCBI Reference Sequence No. NC_000001.11, downloaded Jan. 9, 2024.
NCBI Reference Sequence No. WP_002989955.1, downloaded Jan. 9, 2024.
NCBI Reference Sequence No. WP_010922251.1, downloaded Jan. 9, 2024.
NCBI Reference Sequence No. WP_011054416.1, downloaded Jan. 9, 2024.
NCBI Reference Sequence No. WP_011284745.1, downloaded Jan. 9, 2024.
NCBI Reference Sequence No. WP_011285506.1, downloaded Jan. 9, 2024.
NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.
NCBI Sequence No. WP_001297409.1, downloaded Aug. 14, 2023.
Nelson et al., "In vivo genome editing improves muscle function in a mouse model of Duchenne muscular dystrophy," Science, Jan. 22, 2016, vol. 351, No. 6271, pp. 403-407.
Ousterout et al., "Multiplex CRISPR/Cas9-based genome editing for correction of dystrophin mutations that cause Duchenne muscular dystrophy," Nature Communications, vol. 6, No. 6244, pp. 1-13.
Sang et al., "A unique uracil-DNA binding protein of the uracil DNA glycosylase superfamily," Nucleic Acids Research, Sep. 30, 2015, vol. 43, No. 17, pp. 8452-8463.
Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.
Shee et al., "Engineered proteins detect spontaneous DNA breakage in human and bacterial cells," eLife, 2013, vol. 2, No. e01222, pp. 1-25.
Singh et al., "Splicing of a Critical Exon of Human Survival Motor Neuron is Regulated by a Unique Silencer Element Located in the Last Intron," Molecular and Cellular Biology, Feb. 2006, vol. 26, No. 4, pp. 1333-1346.
Talbot et al., "Spinal muscular atrophy," Journal of Inherited Metabolic Disease, Jun. 2001, vol. 21, No. 2, pp. 189-197 [Abstract Only].
UniProt Accession No. P51908, Downloaded Jan. 9, 2024.
Wirth et al., "Mildly affected patients with spinal muscular atrophy are partially protected by an increased SMN2 copy number," Human Genetics, 2006, vol. 119, pp. 422-428.
Yan et al., "High-efficiency and multiplex adenine base editing in plants using new TadA variants," Molecular Plant, May 3, 2021, vol. 14, pp. 722-731.
Yang et al., "APOBEC: From mutator to editor," Journal of Genetics and Genomics, 2017, vol. 44, pp. 423-437.
Zong et al., "Precise base editing in rice, wheat and maize with a Cas9-cytidine deaminase fusion," Nature Biotechnology, 2017, pp. 1-4.
Burstein et al., "New CRISPR-Cas systems from uncultivated microbes," Nature, Feb. 9, 2017, vol. 542, Article No. 7640, pp. 237-241.
Cheng et al., "Cloning, expression and activity identification of human innate immune protein apolipoprotein B mRNA editing enzyme catalytic subunit 3A(APOBEC3A)," Chinese Journal of Cellular and Molecular Immunology, 2017, vol. 33, No. 2, pp. 179-184 [English Abstract].
Eid et al., "CRISPR base editors: genome editing without double-stranded breaks," Biochemical Journal, 2018, vol. 475, pp. 1955-1964.
Ekstrand et al., "Frequent alterations of the PI3K/AKT/mTOR pathways in hereditary nonpolyposis colorectal cancer," Familial Cancer, 2010, vol. 9, pp. 125-129.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Komor et al., "CRISPR-Based Technologies for the Manipulation of Eukaryotic Genomes," Cell, Jan. 12, 2017, vol. 168, pp. 20-36.

(56)            References Cited

OTHER PUBLICATIONS

Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.

Lavergne et al., "Defects in type IIA von Willebrand disease: a cysteine 509 to arginine substitution in the mature von Willebrand factor disrupts a disulphide loop involved in the interaction with platelet glycoprotein lb-IX," British Journal of Haematology, 1992, vol. 82, pp. 66-72.

Liu et al., "CRISPR-Cas9-mediated multiplex gene editing in CAR-T cells," Cell Research, Jan. 2017, vol. 27, No. 1, pp. 154-157.

Liu et al., "Supplementary information, Figure S1. Multiplex gene editing mediated by CRISPR-Cas9 in primary T cells," Cell Research, Jan. 2017, pp. 1-3 <https://static-content.springer.com/esm/art%3A10.1038%2Fcr.2016.142/MediaObjects/41422_2017_BFcr2016142_MOESM20_ESM.pdf>.

Micozzi et al., "Human cytidine deaminase: A biochemical characterization of its naturally occurring variants," International Journal of Biological Macromolecules, Feb. 2014, vol. 63, pp. 64-74.

Plosky, Brian S., "CRISPR-Mediated Base Editing without DNA Double-Strand Breaks," Molecular Cell, May 19, 2016, vol. 62, pp. 477-478.

Ramakrishna et al., "Gene disruption by cell-penetrating peptide-mediated delivery of Cas9 protein and guide RNA," Genome Research, 2014, vol. 24, pp. 1020-1027.

Ribeiro et al., "Protein Engineering Strategies to Expand CRISPR-Cas9 Applications," Hindawi: International Journal of Genomics, 2018, vol. 2018, No. 1652567, pp. 1-12.

UniProt Accession No. A0A5F1IHX6, downloaded Apr. 11, 2023.

UniProt Accession No. A8AD26, downloaded Apr. 11, 2023.

Webber et al., "Multiplex Human T Cell Engineering without Double-Strand Break Induction Using the Cas9 Base Editor System," Blood, Nov. 29, 2018, vol. 132, Article No. Suppl. 1, p. 3495.

Yong et al., "Base Editing and its Applications in Gene Therapy," Chinese Journal of Otology, 2018, vol. 16, No. 2, pp. 150-154 [English Abstract].

Zhang et al., "Genetic abrogation of immune checkpoints in antigen-specific cytotoxic T-lymphocyte as a potential alternative to blockade immunotherapy," Scientific Reports, 2018, vol. 8, No. 5549, pp. 1-13.

Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].

Glick, Meir. "Novel CD8 T Cell Antagonists Based on 2-Microglobulin*" 20840-20846. The Journal of Biological Chemistry. Web. Mar. 25, 2002; p. 20844, 2nd col. 3rd-4th paragraphs; DOI: 10.1074/jbc. M201819200.

* cited by examiner

Percentage of cells B2M- HLA-DR- CD3- as measured by flow cytometry

| Sample | Donor 2 | Donor 4 | Donor 5 |
|--------|---------|---------|---------|
| ABE7.10-m | 0.14 | 0.14 | 0.067 |
| ABE7.10-d | 0.1 | 0.13 | 0.037 |
| ABE8.20-m | 30.9 | 33.9 | 39.6 |

FIG. 10

MODIFIED IMMUNE CELLS HAVING ADENOSINE DEAMINASE BASE EDITORS FOR MODIFYING A NUCLEOBASE IN A TARGET SEQUENCE

CROSS REFERENCE TO RELATED APPLICATIONS

This application is the U.S. national phase application, pursuant to 35 U.S.C. § 371, of PCT International Application No. PCT/US2020/018178, filed Feb. 13, 2020, which claims priority to and benefit of U.S. Provisional Application Nos. 62/805,271, filed Feb. 13, 2019; 62/852,228, filed May 23, 2019; 62/852,224, filed May 23, 2019; 62/931,722, filed Nov. 6, 2019; 62/941,523 filed Nov. 27, 2019; 62/941,569, filed Nov. 27, 2019; and 62/966,526, filed Jan. 27, 2020, the contents of all of which are incorporated by reference herein in their entireties.

SEQUENCE LISTING

The instant application contains a Sequence Listing which has been submitted electronically in ASCII format and is hereby incorporated by reference in its entirety. Said ASCII copy, created on Mar. 26, 2020, is named 180802-043601PCTSequenceListing.txt and is 1,302,036 bytes in size.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

BACKGROUND OF THE DISCLOSURE

Autologous and allogeneic immunotherapies are neoplasia treatment approaches in which immune cells expressing chimeric antigen receptors are administered to a subject. To generate an immune cell that expresses a chimeric antigen receptor (CAR), the immune cell is first collected from the subject (autologous) or a donor separate from the subject receiving treatment (allogeneic) and genetically modified to express the chimeric antigen receptor. The resulting cell expresses the chimeric antigen receptor on its cell surface (e.g., CAR T-cell), and upon administration to the subject, the chimeric antigen receptor binds to the marker expressed by the neoplastic cell. This interaction with the neoplasia marker activates the CAR-T cell, which then cell kills the neoplastic cell. But for autologous or allogeneic cell therapy to be effective and efficient, significant conditions and cellular responses, such as T cell signaling inhibition, must be overcome or avoided. For allogeneic cell therapy, graft-versus-host disease (GVHD) and host rejection of CAR-T cells may provide additional challenges. Editing genes involved in these processes can enhance CAR-T cell function and resistance to immunosuppression or inhibition, but current methodologies for making such edits have the potential to induce large, genomic rearrangements in the CAR-T cell, thereby negatively impacting its efficacy. Thus, there is a significant need for techniques to more precisely modify immune cells, especially CAR-T cells. This application is directed to this and other important needs.

SUMMARY OF THE DISCLOSURE

The present invention features genetically modified immune cells comprising novel adenosine base editors (e.g., ABE8) having enhanced anti-neoplasia activity, resistance to immune suppression, and decreased risk of eliciting a graft-versus-host reaction or host-versus-graft reaction, or a combination thereof. The present invention also features methods for producing and using these modified immune effector cells.

In one aspect, the invention provides a method for producing a modified immune cell, the method comprising expressing or introducing in an immune cell a nucleobase editor polypeptide and contacting the cell with two or more guide RNAs that target the nucleobase editor polypeptide to effect an alteration in a nucleic acid molecule encoding at least one polypeptide selected from the group consisting of a T Cell Receptor Alpha Constant (TRAC), beta-2 microglobulin (B2M), programmed cell death 1 (PD1), Cluster of Differentiation 7 (CD7), Cluster of Differentiation 5 (CD5), Cluster of Differentiation 33 (CD33), Cluster of Differentiation 123 (CD123), Cbl Proto-Oncogene B (CBLB), and Class II Major Histocompatibility Complex Transactivator (CIITA) polypeptide, wherein the nucleobase editor polypeptide comprises a nucleic acid programmable DNA binding protein (napDNAbp) and an adenosine deaminase variant domain comprising an alteration at amino acid position 82 and/or 166 of MSEVEFSHEYWMRHALTLAKRAR-DEREVPVGAVLVLNNRVIGEGWNRAIGLHDPTAHA-EIMA LRQGGLVMQNYRLIDATLYVTFEPCVMCAG-AMIHSRIGRVVFGVRNAKTGAAGSLMDVLHYP GM-NHRVEITEGILADECAALLCYFFRMPRQVFNAQK-KAQSSTD (SEQ ID NO: 3). In one embodiment, the immune cell is a T cell. In one embodiment, the immune cell is obtained from a healthy subject.

In one embodiment, adenosine deaminase variant domain comprises alterations at amino acid position 82 and 166. In one embodiment, the adenosine deaminase variant domain comprises a V82S alteration. In one embodiment, the adenosine deaminase variant domain comprises a T166R alteration. In one embodiment, the adenosine deaminase variant domain comprises V82S and T166R alterations. In one embodiment, the adenosine deaminase variant domain further comprises one or more of the following alterations: Y147T, Y147R, Q154S, Y123H, and/or Q154R. In one embodiment, the adenosine deaminase variant domain comprises a combination of alterations selected from the group consisting of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In one embodiment, the adenosine deaminase variant domain comprises the combination of alterations: V82S+Q154R. In one embodiment, the adenosine deaminase variant domain comprises the combination of alterations: Y147R+Q154R+Y123H. In one embodiment, the adenosine deaminase variant domain comprises the combination of alterations: Y147R+Q154R+Y123H+I76Y. In one embodiment, the adenosine deaminase variant domain comprises the combination of alterations: I76Y+V82S+Y123H+Y147R+Q154R.

In one embodiment, the adenosine deaminase variant is a TadA*8. In one embodiment, the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, TadA*8.24.

In one embodiment, the adenosine deaminase variant domain comprises a deletion of the C terminus beginning at a residue selected from the group consisting of 149, 150, 151, 152, 153, 154, 155, 156, and 157. In one embodiment, the base editor domain is an adenosine deaminase variant monomer. In one embodiment, the base editor domain is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m In one embodiment, the base editor domain is an adenosine deaminase variant heterodimer comprising a wild-type adenosine deaminase domain and the adenosine deaminase variant domain. In one embodiment, the base editor domain is ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d.

In one embodiment, the base editor domain is an adenosine deaminase variant heterodimer comprising a TadA*7.10 domain and the adenosine deaminase variant domain. In one embodiment, the adenosine deaminase variant domain is missing 1, 2, 3, 4, 5, 6, 7, 8, 9, 10, 11, 12, 13, 14, 15, 6, 17, 18, 19, or 20 N-terminal amino acid residues relative to a full-length adenosine deaminase. In one embodiment, the adenosine deaminase variant domain comprises or consists essentially of the following sequence or a fragment thereof having adenosine deaminase activity:

(SEQ ID NO: 4)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSID.

In one embodiment, the napDNAbp comprises the following sequence:

(SEQ ID NO: 5)
EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPRAFKYF

DTTIARKEYRSTKEVLDATLIHQSITGLYETRIDLSQLGGD*GGSGGSGGS*

*GGSGGSGGSGGM*DKKYSIGLAIGTNSVGWAVITDEYKVPSKKFKVLGNTD

-continued

RHSIKKNLIGALLFDSGETAEATRLKRTARRRYTRRKNRICYLQEIFSNE

MAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLV

QTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADL

FLAAKNLSDAILLSDILRVNTEITRAPLSASMIKRYDEHHQDLTLLKALV

RQQLPEKYKEIFFDQSKNGYAGYIDGGASQEEFYKFIKPILEKMDGTEEL

LVKLNREDLLRKQRTFDNGSIPHQIHLGELHAILRRQEDFYPFLKDNREK

IEKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRM

NTKYDENDKLIREVKVITLKSKLVSDFRKDFQFYKVREINNYHHAHDAYL

NAVVGTALIKKYPKLESEFVYGDYKVYDVRKMIAKSEQ<u>EGADKRTADGSE</u>

<u>FESPKKKRKV</u>*, wherein the bold sequence indicates sequence derived from Cas9, the italics sequence denotes a linker sequence, and the underlined sequence denotes a bipartite nuclear localization sequence.

In various embodiments of any aspect delineated herein, the napDNAbp is a *Staphylococcus aureus* Cas9 (SaCas9), *Streptococcus thermophilus* 1 Cas9 (St1Cas9), a *Streptococcus pyogenes* Cas9 (SpCas9), or variants thereof. In one embodiment, the napDNAbp comprises a variant of SpCas9 having an altered protospacer-adjacent motif (PAM) specificity or specificity for a non-G PAM. In one embodiment, the altered PAM has specificity for the nucleic acid sequence 5'-NGC-3'. In one embodiment, the modified SpCas9 comprises amino acid substitutions D1135M, S1136Q, G1218K, E1219F, A1322R, D1332A, R1335E, and T1337R, or corresponding amino acid substitutions thereof. In various embodiments of any aspect delineated herein, the napDNAbp comprises a nuclease dead Cas9 (dCas9), a Cas9 nickase (nCas9), or a nuclease Cas9. In one embodiment, the nickase variant comprises an amino acid substitution D10A or a corresponding amino acid substitution thereof. In various embodiments of any aspect delineated herein, the nucleobase editor polypeptide further comprises a zinc finger domain. In various embodiments of any aspect delineated herein, the nucleobase editor polypeptide further comprises one or more uracil glycosylase inhibitors. In various embodiments of any aspect delineated herein, the adenosine deaminase variant domain is capable of deaminating adenine in deoxyribonucleic acid (DNA). In various embodiments of any aspect delineated herein, the adenosine deaminase variant domain is a modified adenosine deaminase that does not occur in nature. In various embodiments of any aspect delineated herein, the adenosine deaminase variant is a TadA*8. In some embodiments the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

In various embodiments of any aspect delineated herein, the nucleobase editor polypeptide further comprises a linker between the napDNAbp and the adenosine deaminase variant domain. In one embodiment, the linker comprises the amino acid sequence:

(SEQ ID NO: 6)
SGGSSGGSSGSETPGTSESATPES.

In various embodiments of any aspect delineated herein, the nucleobase editor polypeptide further comprises or more nuclear localization signals (NLS). In one embodiment, the NLS is a bipartite NLS. In one embodiment, the nucleobase editor polypeptide comprises an N-terminal NLS and a C-terminal NLS. In various embodiments of any aspect delineated herein, the napDNAbp is a modified *Staphylococcus aureus* Cas9 (SaCas9). In one embodiment, the modified SaCas9 comprises amino acid substitutions E782K, N968K, and R1015H, or corresponding amino acid substitutions thereof. In one embodiment, the modified SaCas9 comprises the amino acid sequence:

(SEQ ID NO: 7)
KRNYILGLAIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITY

-continued

REYLENMNDKRPPHIIKTIASKTQSIKKYSTDILGNLYEVKSKKHPQIIK

KG.

In various embodiments of any aspect delineated herein, two or more guide RNAs are expressed in or contact the cell, each targeting a separate polynucleotide. In various embodiments, multiplex base editing involves the concurrent modification of 1, 2, 3, 4, 5, 6, 7, 8, 9, 10, 11, 12, 13, 14, 15, 16, 17, 18, 19, 20 or more target genomic loci. In various embodiments of any aspect delineated herein, two guide RNAs are expressed in or contact the cell, each targeting a B2M or TRAC polynucleotide. In various embodiments of any aspect delineated herein, three guide RNAs are expressed in or contact the cell. In various embodiments of any aspect delineated herein, three guide RNAs are expressed in or contact the cell, each targeting a B2M, CD7, TRAC, CIITA, PDCD1 and/or CBLB polynucleotide. In various embodiments of any aspect delineated herein, three guide RNAs are expressed in or contact the cell, each targeting a B2M, TRAC, and PDCD1 polynucleotide. In various embodiments of any aspect delineated herein, three guide RNAs are expressed in or contact the cell, each targeting a B2M, TRAC, and CIITA polynucleotide. In various embodiments of any aspect delineated herein, four guide RNAs are expressed in or contact the cell, each targeting one of a B2M, CD7, TRAC, CIITA PDCD1 and/or CBLB polynucleotide. In various embodiments of any aspect delineated herein, the two or more guide RNAs target a TRAC exon 4 splice acceptor site, B2M exon 1 splice donor site, and/or PDCD1 exon 1 splice donor site. In various embodiments of any aspect delineated herein, the two or more guide RNAs target a splice acceptor site or a splice donor site in a target polynucleotide. In various embodiments of any aspect delineated herein, the nucleobase editor polypeptide generates a stop codon in a target polynucleotide. In various embodiments of any aspect delineated herein, the nucleobase editor polypeptide generates a stop codon in a PDCD1 exon 2. In various embodiments, the expression of one or more of the above polypeptides is reduced by 70, 75, 80, 85, 90, 91, 92, 93, 94, 95, 96, 97, 98, 99% or more, or even 100% relative to a reference by introducing a base editor and one or more guide RNAs that target a gene encoding the polypeptide.

In another aspect, the invention provides expressing a chimeric antigen receptor (CAR) in a modified immune cell of any aspect delineated herein. In various embodiments of any aspect delineated herein, the immune cell is modified ex vivo. In various embodiments of any aspect delineated herein, the immune cell is a cytotoxic T cell, a regulatory T cell, or a T helper cell. In various embodiments of any aspect delineated herein, the modified immune cell comprises no detectable translocations.

In another aspect, the invention provides a modified immune cell produced according to the method of any aspect delineated herein. In various embodiments of any aspect delineated herein, the cell has reduced immunogenicity and increased anti-neoplasia activity. In various embodiments of any aspect delineated herein, the immune cell expresses a chimeric antigen receptor.

In various embodiments of any aspect delineated herein, the immune cell is a T cell. In various embodiments of any aspect delineated herein, the cell comprises one or more mutations in polynucleotides encoding B2M, CD7, CIITA, PD1, CBLB, and/or TRAC. In one embodiment, the cell comprises one or more mutations in polynucleotides encoding B2M, TRAC, and CIITA polynucleotides. In various embodiments of any aspect delineated herein, the cell comprises a mutation in one or more polynucleotides encoding TIGIT. TGFBR2, ZAP70, NFATc1, or TET2. In various embodiments of any aspect delineated herein, the cell comprises a mutation in one or more polynucleotides encoding V-Set Immunoregulatory Receptor (VISTA), T Cell Immunoglobulin Mucin 3 (Tim-3), T Cell Immunoreceptor With Ig and ITIM Domains (TIGIT), Transforming Growth Factor Beta Receptor II (TGFbRII), Regulatory Factor X Associated Ankyrin Containing Protein (RFXANK), PVR Related Immunoglobulin Domain Containing (PVRIG), Lymphocyte-Activation Gene 3 (Lag3), Cytotoxic T-Lymphocyte Associated Protein 4 (CTLA-4), Chitinase 3 Like 1 (Chi3l1), Cluster of Differentiation 96 (CD96), B and T Lymphocyte Associated (BTLA), Tet Methylcytosine Dioxygenase 2 (TET2), Sprouty RTK Signaling Antagonist 1 (Spry 1), Sprouty RTK Signaling Antagonist 2 (Spry2), Class II Major Histocompatibility Complex Transactivator (CIITA), Cluster of Differentiation 7 (CD7), Cluster of Differentiation 33 (CD33), Cluster of Differentiation 52 (CD52), Cluster of Differentiation 123 (CD123), T Cell Receptor Beta Constant 1 (TRBC1), T Cell Receptor Beta Constant 2 (TRBC2), Cytokine Inducible SH2 Containing Protein (CISH), Acetyl-CoA Acetyltransferase 1 (ACAT1), Cytochrome P450 Family 11 Subfamily A Member 1 (Cyp11a1), GATA Binding Protein 3 (GATA3), Nuclear Receptor Subfamily 4 Group A Member 1 (NR4A1), Nuclear Receptor Subfamily 4 Group A Member 2 (NR4A2), Nuclear Receptor Subfamily 4 Group A Member 3 (NR4A3), Methylation-Controlled J Protein (MCJ), Fas Cell Surface Death Receptor (FAS), or Selectin P Ligand/P-Selectin Glycoprotein Ligand-1 (SELPG/PSGL1).

In various embodiments of any aspect delineated herein, the chimeric antigen receptor comprises an extracellular domain having an affinity for a marker associated with neoplasia. In one embodiment, the neoplasia is a multiple myeloma. In various embodiments of any aspect delineated herein, the marker is B cell maturation antigen (BCMA).

In another aspect, the invention provides a method of modulating an immune response in a subject, the method comprising administering an effective amount of a modified immune cell according to any aspect delineated herein. In various embodiments of any aspect delineated herein, the method increases or reduces an immune response.

In another aspect, the invention provides a method of treating a neoplasia in a subject, the method comprising administering to the subject an effective amount of a modified immune cell according to any aspect delineated herein.

In another aspect, the invention provides a pharmaceutical composition for the treatment of a neoplasia comprising an effective amount of a modified immune cell according to any aspect delineated herein.

In another aspect, the invention provides a pharmaceutical composition comprising an effective amount a modified immune cell according to any aspect delineated herein in a pharmaceutically acceptable excipient.

In another aspect, the invention provides a kit for the treatment of a neoplasia comprising a modified immune cell according to any aspect delineated herein. In various embodiments of any aspect delineated herein, the kit further comprises written instructions for using the modified immune effector cell for the treatment of a neoplasia.

In various embodiments of any aspect delineated herein, the modified immune cell further comprises a chimeric antigen receptor having an affinity for a marker associated with the neoplasia. In certain embodiments, the chimeric antigen receptor is introduced into the cell via a viral vector, e.g., a lentiviral vector. In certain embodiments, the chimeric antigen receptor is introduced into the cell via a double-stranded DNA template, to be inserted at a locus cleaved by a nuclease. In various embodiments of any aspect delineated herein, the chimeric antigen receptor comprises an extracellular domain having an affinity for a marker associated with neoplasia.

In various embodiments of any aspect delineated herein, the neoplasia is a B cell cancer. In various embodiments of any aspect delineated herein, the B cell cancer is a lymphoma or a leukemia. In various embodiments of any aspect delineated herein, the B cell cancer is a multiple myeloma.

In another aspect, the invention provides a method of treating a subject having or having a propensity to develop graft-versus-host disease (GVHD) with an effective amount of a modified immune cell according to any aspect delineated herein. In another aspect, the invention provides a pharmaceutical composition for the treatment of GVHD comprising an effective amount of a modified immune cell according to any aspect delineated herein. In another aspect, the invention provides a kit for the treatment of GVHD comprising a modified immune cell according to any aspect delineated herein. In various embodiments of any aspect delineated herein, the modified immune cell lacks or has reduced levels of functional TRAC.

In another aspect, the invention provides a method of treating a subject having or having a propensity to develop host-versus-graft disease (HVGD) with an effective amount of a modified immune cell according to any aspect delineated herein. In another aspect, the invention provides a pharmaceutical composition for the treatment of HVGD comprising an effective amount of a modified immune cell according to any aspect delineated herein. In another aspect, the invention provides a kit for the treatment of HVGD comprising a modified immune cell according to any aspect delineated herein. In various embodiments of any aspect delineated herein, the modified immune cell lacks or has reduced levels of functional B2M.

In another aspect, the invention provides a method for producing a modified immune cell, the method comprising expressing or introducing in an immune cell a nucleobase editor polypeptide and contacting the cell with two or more guide RNAs capable of targeting a nucleic acid molecule encoding at least one polypeptide selected from the group consisting of a T Cell Receptor Alpha Constant (TRAC), beta-2 microglobulin (B2M), programmed cell death 1 (PD1), Cluster of Differentiation 7 (CD7), Cluster of Differentiation 5 (CD5), Cluster of Differentiation 33 (CD33), Cluster of Differentiation 123 (CD123), Cbl Proto-Oncogene B (CBLB), and Class II Major Histocompatibility Complex Transactivator (CIITA) polypeptide, wherein the nucleobase editor polypeptide comprises at least one base adenosine deaminase variant domain inserted within a nucleic acid programmable DNA binding protein (napDNAbp).

In one embodiment, the adenosine deaminase variant domain comprises the amino acid sequence of:

(SEQ ID NO: 3)

MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD

US 12,600,971 B2

9 wherein the amino acid sequence comprises at least one alteration. In one embodiment, the adenosine deaminase variant domain comprises alterations at amino acid position 82 and/or 166. In one embodiment, the at least one alteration comprises: V82S, T166R, Y147T, Y147R, Q154S, Y123H, and/or Q154R. In one embodiment, the adenosine deaminase variant comprises one of the following combination of alterations: Y147T+Q154R; Y147T+Q154S; Y147R+ Q154S; V82S+Q154S; V82S+Y147R; V82S+Q154R; V82S+Y123H; I76Y+V82S; V82S+Y123H+Y147T; V82S+ Y123H+Y147R; V82S+Y123H+Q154R; Y147R+Q154R+ Y123H; Y147R+Q154R+I76Y; Y147R+Q154R+T166R; Y123H+Y147R+Q154R+I76Y; V82S+Y123H+Y147R+ Q154R; and I76Y+V82S+Y123H+Y147R+Q154R. In one embodiment, the adenosine deaminase variant is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, TadA*8.24. In one embodiment, the adenosine deaminase variant comprises a deletion of the C terminus beginning at a residue selected from the group consisting of 149, 150, 151, 152, 153, 154, 155, 156, and 157. In one embodiment, the adenosine deaminase variant domain is an adenosine deaminase monomer. In one embodiment, the adenosine deaminase variant is an adenosine deaminase heterodimer comprising a wild-type adenosine deaminase domain and an adenosine deaminase variant domain. In one embodiment, the adenosine deaminase variant is an adenosine deaminase heterodimer comprising a TadA domain and an adenosine deaminase variant domain.

In another embodiment, the napDNAbp is a Cas9 or Cas12 polypeptide. In one embodiment, the adenosine deaminase variant is inserted within a flexible loop, an alpha helix region, an unstructured portion, or a solvent accessible portion of the napDNAbp. In one embodiment, the adenosine deaminase variant is flanked by a N-terminal fragment and a C-terminal fragment of the napDNAbp. In one embodiment, the nucleobase editor polypeptide comprises the structure NH₂-[N-terminal fragment of the napDNAbp]-[adenosine deaminase variant]-[C-terminal fragment of the napDNAbp]-COOH, wherein each instance of "]-[" is an optional linker. In one embodiment, the C-terminus of the N terminal fragment or the N-terminus of the C terminal fragment comprises a part of a flexible loop of the napD-NAbp. In one embodiment, the flexible loop comprises an amino acid in proximity to a target nucleobase. In one embodiment, the target nucleobase is 1-20 nucleobases away from a PAM sequence in the target polynucleotide sequence. In one embodiment, the target nucleobase is 2-12 nucleobases upstream of the PAM sequence. In one embodiment, the N-terminal fragment or the C-terminal fragment of the napDNAbp binds the target polynucleotide sequence.

In some embodiments, the N-terminal fragment or the C-terminal fragment comprises a RuvC domain: the N-terminal fragment or the C-terminal fragment comprises a HNH domain; neither of the N-terminal fragment and the C-terminal fragment comprises an HNH domain; or neither of the N-terminal fragment and the C-terminal fragment comprises a RuvC domain. In some embodiments, the napDNAbp comprises a partial or complete deletion in one or more structural domains and wherein the deaminase is inserted at the partial or complete deletion position of the napDNAbp. In some embodiments, the deletion is within a RuvC domain; the deletion is within an HNH domain; or the deletion bridges a RuvC domain and a C-terminal domain, a L-I domain and a HNH domain, or a RuvC domain and a L-I domain.

In another embodiments, the napDNAbp is a Cas9 or Cas12 polypeptide. In one embodiment, the napDNAbp comprises a Cas9 polypeptide. In one embodiment, the Cas9 polypeptide is a *Streptococcus pyogenes* Cas9 (SpCas9), *Staphylococcus aureus* Cas9 (SaCas9), *Streptococcus thermophilus*]Cas9 (St1Cas9), or variants thereof. In one embodiment, the Cas9 polypeptide the following amino acid sequence (Cas9 reference sequence):

(SEQ ID NO: 8)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

-continued

```
VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(single underline: HNH domain; double underline:
RuvC domain; (Cas9 reference sequence), or a
corresponding region thereof
```

In some embodiments, the Cas9 polypeptide comprises a deletion of amino acids 1017-1069 as numbered in the Cas9 polypeptide reference sequence or corresponding amino acids thereof; the Cas9 polypeptide comprises a deletion of amino acids 792-872 as numbered in the Cas9 polypeptide reference sequence or corresponding amino acids thereof; or the Cas9 polypeptide comprises a deletion of amino acids 792-906 as numbered in the Cas9 polypeptide reference sequence or corresponding amino acids thereof. In one embodiment, the adenosine deaminase variant is inserted within a flexible loop of the Cas9 polypeptide. In one embodiment, the flexible loop comprises a region selected from the group consisting of amino acid residues at positions 530-537, 569-579, 686-691, 768-793, 943-947, 1002-1040, 1052-1077, 1232-1248, and 1298-1300 as numbered in the Cas9 reference sequence, or corresponding amino acid positions thereof. In one embodiment, the deaminase is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the Cas9 reference sequence, or corresponding amino acid positions thereof. In one embodiment, the deaminase is inserted between amino acid positions 768-769, 792-793, 1022-1023, 1026-1027, 1040-1041, 1068-1069, or 1247-1248 as numbered in the Cas9 reference sequence or corresponding amino acid positions thereof. In one embodiment, the deaminase is inserted between amino acid positions 1016-1017, 1023-1024, 1029-1030, 1040-1041, 1069-1070, or 1247-1248 as numbered in the Cas9 reference sequence or corresponding amino acid positions thereof. In one embodiment, adenosine deaminase variant is inserted within the Cas9 polypeptide at the loci identified in Table 13A. In one embodiment, the N-terminal fragment comprises amino acid residues 1-529, 538-568, 580-685, 692-942, 948-1001, 1026-1051, 1078-1231, and/or 1248-1297 of the Cas9 reference sequence, or corresponding residues thereof. In one embodiment, the C-terminal fragment comprises amino acid residues 1301-1368, 1248-1297, 1078-1231, 1026-1051, 948-1001, 692-942, 580-685, and/or 538-568 of the Cas9 reference sequence, or corresponding residues thereof.

In another embodiment, the Cas9 polypeptide is a modified Cas9 and has specificity for an altered PAM. In one embodiment, the Cas9 polypeptide is a nickase or wherein the Cas9 polypeptide is nuclease inactive. In one embodiment, the Cas9 polypeptide is a modified SpCas9 polypeptide. In one embodiment, the modified SpCas9 polypeptide, which includes amino acid substitutions D1135M, S1136Q, G1218K, E1219F, A1322R, D1332A, R1335E, and T1337R (SpCas9-MQKFRAER) and which has specificity for the altered PAM 5'-NGC-3'.

In some embodiments, the adenosine deaminase variant is inserted in a Cas12 polypeptide. In one embodiment, the Cas12 polypeptide is Cas12a, Cas12b, Cas12c, Cas12d, Cas12e, Cas12g, Cas12h, or Cas12i. In one embodiment, the adenosine deaminase variant is inserted between amino acid positions: a) 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, or Cas12i; b) 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, or Cas12i; or c) 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, or Cas12i. In one embodiment, the adenosine deaminase variant is inserted within the Cas12 polypeptide at the loci identified in Table 13B. In one embodiment, the Cas12 polypeptide is Cas12b. In one embodiment, the Cas12 polypeptide comprises a BhCas12b domain, a BvCas12b domain, or an AACas12b domain.

In one aspect, the invention provides a modified immune cell produced according to any of the methods provided herein. In one embodiment, the immune cell is a T cell. In one embodiment, the immune cell expresses a chimeric antigen receptor. In one embodiment, the method comprising administering an effective amount of any of the modified immune cells as provided herein. In another aspect, the invention provides a pharmaceutical composition comprising an effective amount any of the modified immune cells provided herein in a pharmaceutically acceptable excipient.

In yet another aspect, the invention provides a kit comprising any of the modified immune cells as provided herein.

In one aspect, provided herein is a base editor system comprising a polynucleotide programmable DNA binding domain and at least one base editor domain that comprises an adenosine deaminase variant comprising an alteration at amino acid position 82 or 166 of (SEQ ID NO: 3)
MSEVEFSHEYWMRHALTLAKRARDEREVPVGAVLVLNNRVIGEGWNRAIG

LHDPTAHAEEVIALRQGGLVMQNYRLIDATLYVTFEPCVMCAGAMIHSRI

GRVVFGVRNAKTGAAGSLMDVLHYPGMNHRVEITEGILADECAALLCYFF

RMPRQVFNAQKKAQSSTD and two or more guide RNAs that target the nucleobase editor polypeptide from the group consisting of a T Cell Receptor Alpha Constant (TRAC), beta-2 microglobulin (B2M), programmed cell death 1 (PD1), Cluster of Differentiation 7 (CD7), Cluster of Differentiation 5 (CD5), Cluster of Differentiation 33 (CD33), Cluster of Differentiation 123 (CD123), Cbl Proto-Oncogene B (CBLB), and Class II Major Histocompatibility Complex Transactivator (CIITA) polypeptide. In some embodiments, the adenosine deaminase variant comprises a V82S alteration and/or a T166R alteration. In some embodiments, the adenosine deaminase variant further comprises one or more of the following alterations: Y147T, Y147R, Q154S, Y123H, and Q154R. In some embodiments, the base editor domain comprises an adenosine deaminase heterodimer comprising a wild-type adenosine deaminase domain and an adenosine deaminase variant. In some embodiments, the adenosine deaminase variant is a truncated TadA8 that is missing 1, 2, 3, 4, 5, 6, 7, 8, 9, 10, 11, 12, 13, 14, 15, 6, 17, 18, 19, or 20 N-terminal amino acid residues relative to the full length TadA8. In some embodiments, the adenosine deaminase variant is a truncated TadA8 that is missing 1, 2, 3, 4, 5, 6, 7, 8, 9, 10, 11, 12, 13, 14, 15, 6, 17, 18, 19, or 20 C-terminal amino acid residues relative to the full length TadA8. In some embodiments, the polynucleotide programmable DNA binding domain is a modified *Staphylococcus aureus* Cas9 (SaCas9), *Streptococcus thermophilus* 1 Cas9 (St1Cas9), a modified *Streptococcus pyogenes* Cas9 (SpCas9), or variants thereof. In some embodiments, the polynucleotide programmable DNA binding domain is a variant of SpCas9 having an altered protospacer-adjacent motif (PAM) specificity or specificity for a non-G PAM. In some embodiments, the polynucleotide programmable DNA binding domain is a nuclease inactive Cas9. In some embodiments, the polynucleotide programmable DNA binding domain is a Cas9 nickase.

In one aspect, provided herein is a base editor system comprising two or more guide RNAs and a fusion protein comprising a polynucleotide programmable DNA binding domain comprising the following sequence:

(SEQ ID NO: 5)
EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

-continued

KRVILADANLDKVLSAYNKHRDKPIREQAENIIHLFTLTNLGAPRAFKYF

DTTIARKEYRSTKEVLDATLIHQSITGLYETRIDLSQLGGD*GGSGGSGGS*

*GGSGGSGGSGGM*DKKYSIGLAIGTNSVGWAVITDEYKVPSKKFKVLGNTD

RHSIKKNLIGALLFDSGETAEATRLKRTARRRYTRRKNRICYLQEIFSNE

MAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLV

QTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEEL

LVKLNREDLLRKQRTFDNGSIPHQIHLGELHAILRRQEDFYPFLKDNREK

IEKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRM

NTKYDENDKLIREVKVITLKSKLVSDFRKDFQFYKVREINNYHHAHDAYL

NAVVGTALIKKYPKLESEFVYGDYKVYDVRKMIAKSEQ<u>EGADKRTADGSE</u>

<u>FESPKKKRKV</u>*, wherein the bold sequence indicates sequence derived from Cas9, the italics sequence denotes a linker sequence, and the underlined sequence denotes a bipartite nuclear localization sequence, and at least one base editor domain comprising an adenosine deaminase variant comprising an alteration at amino acid position 82 and/or 166 of (SEQ ID NO: 9)
MSEVEFSHEYWMRHALTLAKRARDEREVPVGAVLVLNNRVIGEGWNRAIG

LHDPTAHAEEVIALRQGGLVMQNYRLIDATLYVTFEPCVMCAGAMIHSRI

GRVVFGVRNAKTGAAGSLMDVLHYPGMNHRVEITEGILADECAALLCYFF

RMPRQVFNAQKKAQSST, and wherein the two or more guide RNAs target the nucleobase editor polypeptide to effect an alteration in a nucleic acid molecule encoding at least one polypeptide selected from the group consisting of a T Cell Receptor Alpha Constant (TRAC), beta-2 microglobulin (B2M), programmed cell death 1 (PD1), Cluster of Differentiation 7 (CD7), Cluster of Differentiation 5 (CD5), Cluster of Differentiation 33 (CD33), Cluster of Differentiation 123 (CD123), Cbl Proto-Oncogene B (CBLB), and Class II Major Histocompatibility Complex Transactivator (CIITA) polypeptide.

In an aspect, a cell comprising of any one of the above delineated base editor system is provided. of any one of the cell is a human cell or a mammalian cell. In some embodiments, the cell is ex vivo, in vivo, or in vitro.

The description and examples herein illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

The practice of some embodiments disclosed herein employ, unless otherwise indicated, conventional techniques of immunology, biochemistry, chemistry, molecular biology, microbiology, cell biology, genomics and recombinant DNA, which are within the skill of the art. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)).

The section headings used herein are for organizational purposes only and are not to be construed as limiting the subject matter described.

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment. The section headings used herein are for organizational purposes only and are not to be construed as limiting the subject matter described.

The features of the present disclosure are set forth with particularity in the appended claims. A better understanding of the features and advantages of the present will be obtained by reference to the following detailed description that sets forth illustrative embodiments, in which the principles of the disclosure are utilized, and in view of the accompanying drawings as described hereinbelow.

Definitions

The following definitions supplement those in the art and are directed to the current application and are not to be imputed to any related or unrelated case, e.g., to any commonly owned patent or application. Although any methods and materials similar or equivalent to those described herein can be used in the practice for testing of the present disclosure, the preferred materials and methods are described herein. Accordingly, the terminology used herein is for the purpose of describing particular embodiments only, and is not intended to be limiting.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It must be noted that, as used in the specification, the singular forms "a," "an," and "the" include plural references unless the context clearly dictates otherwise. In this application, the use of "or" means "and/or," unless stated otherwise, and is understood to be inclusive. Furthermore, use of the term "including" as well as other forms, such as "include," "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, such as within 5-fold or within 2-fold, of a value. Where particular values are described in the application and claims, unless otherwise stated the term "about" meaning within an acceptable error range for the particular value should be assumed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g., engineered adenosine deaminases, evolved adenosine deaminases) provided herein may be from any organism, such as a bacterium.

In some embodiments, the adenosine deaminase is a TadA deaminase. In some embodiments, the TadA deaminase is TadA variant. In some embodiments, the TadA variant is a
TadA*8. In some embodiments, the deaminase or deaminase
domain is a variant of a naturally occurring deaminase from
an organism, such as a human, chimpanzee, gorilla, monkey,
cow, dog, rat, or mouse. In some embodiments, the deami-
nase or deaminase domain does not occur in nature. For
example, in some embodiments, the deaminase or deami-
nase domain is at least 50%, at least 55%, at least 60%, at
least 65%, at least 70%, at least 75% at least 80%, at least
85%, at least 90%, at least 91%, at least 92%, at least 93%,
at least 94%, at least 95%, at least 96%, at least 97%, at least
98%, at least 99%, at least 99.1%, at least 99.2%, at least
99.3%, at least 99.4%, at least 99.5%, at least 99.6%, at least
99.7%, at least 99.8%, or at least 99.9% identical to a
naturally occurring deaminase. For example, deaminase
domains are described in International PCT Application
Nos. PCT/2017/045381 (WO 2018/027078) and PCT/
US2016/058344 (WO 2017/070632), each of which is incor-
porated herein by reference for its entirety. Also, see Komor,
A. C., et al., "Programmable editing of a target base in
genomic DNA without double-stranded DNA cleavage"
Nature 533, 420-424 (2016); Gaudelli, N. M., et al., "Pro-
grammable base editing of A•T to G•C in genomic DNA
without DNA cleavage" Nature 551, 464-471 (2017);
Komor, A. C., et al., "Improved base excision repair inhi-
bition and bacteriophage Mu Gam protein yields C:G-to-
T:A base editors with higher efficiency and product purity"
Science Advances 3:eaao4774 (2017)), and Rees, H. A., et
al., "Base editing: precision chemistry on the genome and
transcriptome of living cells." Nat Rev Genet. 2018 Decem-
ber; 19(12):770-788. doi: 10.1038/s41576-018-0059-1, the
entire contents of which are hereby incorporated by refer-
ence.

A wild type TadA(wt) adenosine deaminase has the fol-
lowing sequence (also termed TadA reference sequence):

```
                                    (SEQ ID NO: 2)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD
```

In some embodiments, the adenosine deaminase com-
prises an alteration in the following sequence:

```
                                    (SEQ ID NO: 3)
MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCYFFR MPRQVFNAQK

KAQSSTD
```

(also termed TadA*7.10).

In some embodiments, TadA*7.10 comprises at least one
alteration. In some embodiments, TadA*7.10 comprises an
alteration at amino acid 82 and/or 166. In particular embodi-
ments, a variant of the above-referenced sequence comprises
one or more of the following alterations: Y147T, Y147R,
Q154S, Y123H, V82S, T166R, and/or Q154R. The altera-
tion Y123H is also referred to herein as H123H (the altera-
tion H123Y in TadA*7.10 reverted back to Y123H (wt)). In
other embodiments, a variant of the TadA*7.10 sequence comprises a combination of alterations selected from the
group of: Y147T+Q154R; Y147T+Q154S; Y147R+Q154S;
V82S+Q154S; V82S+Y147R; V82S+Q154R; V82S+
Y123H; 176Y+V82S; V82S+Y123H+Y147T; V82S+
Y123H+Y147R; V82S+Y123H+Q154R; Y147R+Q154R+
Y123H; Y147R+Q154R+176Y; Y147R+Q154R+T166R;
Y123H+Y147R+Q154R+176Y; V82S+Y123H+Y147R+
Q154R; and 176Y+V82S+Y123H+Y147R+Q154R.

In other embodiments, the invention provides adenosine
deaminase variants that include deletions, e.g., TadA*8,
comprising a deletion of the C terminus beginning at residue
149, 150, 151, 152, 153, 154, 155, 156, or 157, relative to
TadA*7.10, the TadA reference sequence, or a correspond-
ing mutation in another TadA. In other embodiments, the
adenosine deaminase variant is a TadA (e.g., TadA*8) mono-
mer comprising one or more of the following alterations:
Y147T, Y147R, Q154S, Y123H, V82S, T166R, and/or
Q154R, relative to TadA*7.10, the TadA reference sequence,
or a corresponding mutation in another TadA. In other
embodiments, the adenosine deaminase variant is a mono-
mer comprising a combination of alterations selected from
the group of: Y147T+Q154R; Y147T+Q154S; Y147R+
Q154S; V82S+Q154S; V82S+Y147R; V82S+Q154R;
V82S+Y123H; 176Y+V82S; V82S+Y123H+Y147T;
V82S+Y123H+Y147R; V82S+Y123H+Q154R; Y147R+
Q154R+Y123H; Y147R+Q154R+176Y; Y147R+Q154R+
T166R; Y123H+Y147R+Q154R+176Y; V82S+Y123H+
Y147R+Q154R; and 176Y+V82S+Y123H+Y147R+
Q154R, relative to TadA*7.10, the TadA reference sequence,
or a corresponding mutation in another TadA.

In still other embodiments, the adenosine deaminase
variant is a homodimer comprising two adenosine deami-
nase domains (e.g., TadA*8) each having one or more of the
following alterations Y147T, Y147R, Q154S, Y123H,
V82S, T166R, and/or Q154R, relative to TadA*7.10, the
TadA reference sequence, or a corresponding mutation in
another TadA. In other embodiments, the adenosine deami-
nase variant is a homodimer comprising two adenosine
deaminase domains (e.g., TadA*8) each having a combina-
tion of alterations selected from the group of: Y147T+
Q154R; Y147T+Q154S; Y147R+Q154S; V82S+Q154S;
V82S+Y147R; V82S+Q154R; V82S+Y123H; 176Y+V82S;
V82S+Y123H+Y147T; V82S+Y123H+Y147R; V82S+
Y123H+Q154R; Y147R+Q154R+Y123H; Y147R+Q154R+
176Y; Y147R+Q154R+T166R; Y123H+Y147R+Q154R+
176Y; V82S+Y123H+Y147R+Q154R; and I76Y+V82S+
Y123H+Y147R+Q154R, relative to TadA*7.10, the TadA
reference sequence, or a corresponding mutation in another
TadA.

In other embodiments, the adenosine deaminase variant is
a heterodimer comprising a wild-type TadA adenosine
deaminase domain and an adenosine deaminase variant
domain (e.g., TadA*8) comprising one or more of the
following alterations Y147T, Y147R, Q154S, Y123H,
V82S, T166R, and/or Q154R, relative to TadA*7.10, the
TadA reference sequence, or a corresponding mutation in
another TadA. In other embodiments, the adenosine deami-
nase variant is a heterodimer comprising a wild-type TadA
adenosine deaminase domain and an adenosine deaminase
variant domain (e.g. TadA*8) comprising a combination of
alterations selected from the group of: Y147T+Q154R;
Y147T+Q154S; Y147R+Q154S; V82S+Q154S; V82S+
Y147R; V82S+Q154R; V82S+Y123H; I76Y+V82S; V82S+
Y123H+Y147T; V82S+Y123H+Y147R; V82S+Y123H+
Q154R; Y147R+Q154R+Y123H; Y147R+Q154R+176Y;
Y147R+Q154R+T166R; Y123H+Y147R+Q154R+I76Y;
V82S+Y123H+Y147R+Q154R; and I76Y+V82S+Y123H+

Y147R+Q154R, relative to TadA*7.10, the TadA reference sequence, or a corresponding mutation in another TadA.

In other embodiments, the adenosine deaminase variant is a heterodimer comprising a TadA*7.10 domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer comprising a TadA*7.10 domain and an adenosine deaminase variant domain (e.g. TadA*8) comprising a combination of the following alterations: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; or I76Y+V82S+Y123H+Y147R+Q154R, relative to TadA*7.10, the TadA reference sequence, or a corresponding mutation in another TadA.

In one embodiment, the adenosine deaminase is a TadA*8 that comprises or consists essentially of the following sequence or a fragment thereof having adenosine deaminase activity:

(SEQ ID NO: 4)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD.

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In particular embodiments, an adenosine deaminase heterodimer comprises a TadA*8 domain and an adenosine deaminase domain selected from one of the following:

Staphylococcus aureus (S. aureus) TadA:
(SEQ ID NO: 10)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN

Bacillus subtilis (B. subtilis) TadA:
(SEQ ID NO: 11)
MTQDELYMKEAIKEAKKAEEKGEVPIGAVLVINGEIIARAHNLRETEQRS

IAHAEMLVIDEACKALGTWRLEGATLYVTLEPCPMCAGAVVLSRVEKVVF

GAFDPKGGCSGTLMNLLQEERFNHQAEVVSGVLEEECGGMLSAFFRELRK

KKKAARKNLSE

-continued

Salmonella typhimurium (S. typhimurium) TadA:
(SEQ ID NO: 12)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

Shewanella putrefaciens (S. putrefaciens) TadA:
(SEQ ID NO: 13)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

Haemophilus influenzae F3031 (H. influenzae) TadA:
(SEQ ID NO: 14)
MDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

Caulobacter crescentus (C. crescentus) TadA:
(SEQ ID NO: 15)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

Geobacter sulfurreducens (G. sulfurreducens) TadA:
(SEQ ID NO: 16)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

TadA*7.10
(SEQ ID NO: 3)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD

"Administering" is referred to herein as providing one or more compositions described herein to a patient or a subject. By way of example and without limitation, composition administration, e.g., injection, can be performed by intravenous (i.v.) injection, sub-cutaneous (s.c.) injection, intradermal (i.d.) injection, intraperitoneal (i.p.) injection, or intramuscular (i.m.) injection. One or more such routes can be employed. Parenteral administration can be, for example, by bolus injection or by gradual perfusion over time. Alternatively, or concurrently, administration can be by the oral route.

By "agent" is meant any small molecule chemical compound, antibody, nucleic acid molecule, or polypeptide, or fragments thereof.

"Allogeneic," as used herein, refers to cells of the same species that differ genetically to the cell in comparison.

By "alteration" is meant a change (e.g. increase or decrease) in the structure, expression levels or activity of a gene or polypeptide as detected by standard art known methods such as those described herein. As used herein, an alteration includes a change in a polynucleotide or polypeptide sequence or a change in expression levels, such as a 25% change, a 40% change, a 50% change, or greater.

By "ameliorate" is meant decrease, suppress, attenuate, diminish, arrest, or stabilize the development or progression of a disease.

By "analog" is meant a molecule that is not identical, but has analogous functional or structural features. For example, a polynucleotide or polypeptide analog retains the biological activity of a corresponding naturally-occurring polynucleotide or polypeptide, while having certain modifications that enhance the analog's function relative to a naturally occurring polynucleotide or polypeptide. Such modifications could increase the analog's affinity for DNA, efficiency, specificity, protease or nuclease resistance, membrane permeability, and/or half-life, without altering, for example, ligand binding. An analog may include an unnatural nucleotide or amino acid.

By "anti-neoplasia activity" is meant preventing or inhibiting the maturation and/or proliferation of neoplasms.

"Autologous," as used herein, refers to cells from the same subject.

By "base editor (BE)" or "nucleobase editor (NBE)" is meant an agent that binds a polynucleotide and has nucleobase modifying activity. In various embodiment, the base editor comprises a nucleobase modifying polypeptide (e.g., a deaminase) and a nucleic acid programmable nucleotide binding domain in conjunction with a guide polynucleotide (e.g., guide RNA). In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to a deaminase domain. In one embodiment, the agent is a fusion protein comprising a domain having base editing activity. In another embodiment, the protein domain having base editing activity is linked to the guide RNA (e.g., via an RNA binding motif on the guide RNA and an RNA binding domain fused to the deaminase). In some embodiments, the domain having base editing activity is capable of deaminating a base within a nucleic acid molecule. In some embodiments, the base editor is capable of deaminating one or more bases within a DNA molecule. In some embodiments, the base editor is capable of deaminating an adenosine (A) within DNA. In some embodiments, the base editor is an adenosine base editor (ABE).

In some embodiments, base editors are generated (e.g. ABE8) by cloning an adenosine deaminase variant (e.g., TadA*8) into a scaffold that includes a circular permutant Cas9 (e.g., spCAS9 or saCAS9) and a bipartite nuclear localization sequence. Circular permutant Cas9s are known in the art and described, for example, in Oakes et al., Cell 176, 254-267, 2019. Exemplary circular permutants follow where the bold sequence indicates sequence derived from Cas9, the italics sequence denotes a linker sequence, and the underlined sequence denotes a bipartite nuclear localization sequence.

CP5 (with MSP "NGC=Pam Variant with mutations Regular Cas9 likes NGG" PID=Protein Interacting Domain and "D10A" nickase):

(SEQ ID NO: 5)

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

-continued

PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPRAFKYF

DTTIARKEYRSTKEVLDATLIHQSITGLYETRIDLSQLGGD*GGSGGSGGS*

*GGSGGSGGSGGM*DKKYSIGLAIGTNSVGWAVITDEYKVPSKKFKVLGNTD

RHSIKKNLIGALLFDSGETAEATRLKRTARRRYTRRKNRICYLQEIFSNE

MAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLV

QTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEEL

LVKLNREDLLRKQRTFDNGSIPHQIHLGELHAILRRQEDFYPFLKDNREK

IEKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRM

NTKYDENDKLIREVKVITLKSKLVSDFRKDFQFYKVREINNYHHAHDAYL

NAVVGTALIKKYPKLESEFVYGDYKVYDVRKMIAKSEQ<u>EGADKRTADGSE</u>

<u>FESPKKKRKV</u>*

In some embodiments, the ABE8 is selected from a base editor from Table 8, 9, 10, or 11 infra. In some embodiments, ABE8 contains an adenosine deaminase variant evolved from TadA. In some embodiments, the adenosine deaminase variant of ABE8 is a TadA*8 variant as described in Table 9 infra. In some embodiments, the adenosine deaminase variant is TadA*7.10 variant (e.g. TadA*8) comprising one or more of an alteration selected from the group of Y147T, Y147R, Q154S, Y123H, V82S, T166R, and/or Q154R. In various embodiments, ABE8 comprises TadA*7.10 variant (e.g. TadA*8) with a combination of alterations selected from the group of Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In some embodiments ABE8 is a monomeric construct. In some embodiments, ABE8 is a heterodimeric construct. In some embodiments, the ABE8 comprises the sequence:

```
                                        (SEQ ID NO: 4)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD.
```

In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. Details of base editors are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage"

Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By way of example, the adenine base editor (ABE) as used in the base editing compositions, systems and methods described herein has the nucleic acid sequence (8877 base pairs), (Addgene, Watertown, MA.; Gaudelli N M, et al., Nature. 2017 Nov. 23; 551(7681):464-471. doi: 10.1038/nature24644; Koblan L W, et al., Nat Biotechnol. 2018 October; 36(9):843-846. doi: 10.1038/nbt.4172.) as provided below. Polynucleotide sequences having at least 95% or greater identity to the ABE nucleic acid sequence are also encompassed.

```
                                       (SEQ ID NO: 17)
ATATGCCAAGTACGCCCCCTATTGACGTCAATGACGGTAAATGGCCCGCCTGGCATTATGCCCAGTACAT

GACCTTATGGGACTTTCCTACTTGGCAGTACATCTACGTATTAGTCATCGCTATTACCATGGTGATGCGG

TTTTGGCAGTACATCAATGGGCGTGGATAGCGGTTTGACTCACGGGGATTTCCAAGTCTCCACCCCATTG

ACGTCAATGGGAGTTTGTTTTGGCACCAAAATCAACGGGACTTTCCAAAATGTCGTAACAACTCCGCCCC

ATTGACGCAAATGGGCGGTAGGCGTGTACGGTGGGAGGTCTATATAAGCAGAGCTGGTTTAGTGAACCGT

CAGATCCGCTAGAGATCCGCGGCCGCTAATACGACTCACTATAGGGAGAGCCGCCACCATGAAACGGACA

GCCGACGGAAGCGAGTTCGAGTCACCAAAGAAGAAGCGGAAAGTCTCTGAAGTCGAGTTTAGCCACGAGT

ATTGGATGAGGCACGCACTGACCCTGGCAAAGCGAGCATGGGATGAAAGAGAAGTCCCCGTGGGCGCCGT

GCTGGTGCACAACAATAGAGTGATCGGAGAGGGATGGAACAGGCCAATCGGCCGCCACGACCCTACCGCA

CACGCAGAGATCATGGCACTGAGGCAGGGAGGCCTGGTCATGCAGAATTACCGCCTGATCGATGCCACCC

TGTATGTGACACTGGAGCCATGCGTGATGTGCGCAGGAGCAATGATCCACAGCAGGATCGGAAGAGTGGT

GTTCGGAGCACGGGACGCCAAGACCGGCGCAGCAGGCTCCCTGATGGATGTGCTGCACCACCCCGGCATG

AACCACCGGGTGGAGATCACAGAGGGAATCCTGGCAGACGAGTGCGCCGCCCTGCTGAGCGATTTCTTTA

GAATGCGGAGACAGGAGATCAAGGCCCAGAAGAAGGCACAGAGCTCCACCGACTCTGGAGGATCTAGCGG

AGGATCCTCTGGAAGCGAGACACCAGGCACAAGCGAGTCCGCCACACCAGAGAGCTCCGGCGGCTCCTCC

GGAGGATCCTCTGAGGTGGAGTTTTCCCACGAGTACTGGATGAGACATGCCCTGACCCTGGCCAAGAGGG

CACGCGATGAGAGGGAGGTGCCTGTGGGAGCCGTGCTGGTGCTGAACAATAGAGTGATCGGCGAGGGCTG

GAACAGAGCCATCGGCCTGCACGACCCAACAGCCCATGCCGAAATTATGGCCCTGAGACAGGGCGGCCTG

GTCATGCAGAACTACAGACTGATTGACGCCACCCTGTACGTGACATTCGAGCCTTGCGTGATGTGCGCCG

GCGCCATGATCCACTCTAGGATCGGCCGCGTGGTGTTTGGCGTGAGGAACGCAAAAACCGGCGCCGCAGG

CTCCCTGATGGACGTGCTGCACTACCCCGGCATGAATCACCGCGTCGAAATTACCGAGGGAATCCTGGCA

GATGAATGTGCCGCCCTGCTGTGCTATTTCTTTCGGATGCCTAGACAGGTGTTCAATGCTCAGAAGAAGG

CCCAGAGCTCCACCGACTCCGGAGGATCTAGCGGAGGCTCCTCTGGCTCTGAGACACCTGGCACAAGCGA

GAGCGCAACACCTGAAAGCAGCGGGGGCAGCAGCGGGGGGTCAGACAAGAAGTACAGCATCGGCCTGGCC

ATCGGCACCAACTCTGTGGGCTGGGCCGTGATCACCGACGAGTACAAGGTGCCCAGCAAGAAATTCAAGG

TGCTGGGCAACACCGACCGGCACAGCATCAAGAAGAACCTGATCGGAGCCCTGCTGTTCGACAGCGGCGA
```

-continued

```
AACAGCCGAGGCCACCCGGCTGAAGAGAACCGCCAGAAGAAGATACACCAGACGGAAGAACCGGATCTGC

TATCTGCAAGAGATCTTCAGCAACGAGATGGCCAAGGTGGACGACAGCTTCTTCCACAGACTGGAAGAGT

CCTTCCTGGTGGAAGAGGATAAGAAGCACGAGCGGCACCCCATCTTCGGCAACATCGTGGACGAGGTGGC

CTACCACGAGAAGTACCCCACCATCTACCACCTGAGAAAGAAACTGGTGGACAGCACCGACAAGGCCGAC

CTGCGGCTGATCTATCTGGCCCTGGCCCACATGATCAAGTTCCGGGGCCACTTCCTGATCGAGGGCGACC

TGAACCCCGACAACAGCGACGTGGACAAGCTGTTCATCCAGCTGGTGCAGACCTACAACCAGCTGTTCGA

GGAAAACCCCATCAACGCCAGCGGCGTGGACGCCAAGGCCATCCTGTCTGCCAGACTGAGCAAGAGCAGA

CGGCTGGAAAATCTGATCGCCCAGCTGCCCGGCGAGAAGAAGAATGGCCTGTTCGGAAACCTGATTGCCC

TGAGCCTGGGCCTGACCCCCAACTTCAAGAGCAACTTCGACCTGGCCGAGGATGCCAAACTGCAGCTGAG

CAAGGACACCTACGACGACGACCTGGACAACCTGCTGGCCCAGATCGGCGACCAGTACGCCGACCTGTTT

CTGGCCGCCAAGAACCTGTCCGACGCCATCCTGCTGAGCGACATCCTGAGAGTGAACACCGAGATCACCA

AGGCCCCCCTGAGCGCCTCTATGATCAAGAGATACGACGAGCACCACCAGGACCTGACCCTGCTGAAAGC

TCTCGTGCGGCAGCAGCTGCCTGAGAAGTACAAAGAGATTTTCTTCGACCAGAGCAAGAACGGCTACGCC

GGCTACATTGACGGCGGAGCCAGCCAGGAAGAGTTCTACAAGTTCATCAAGCCCATCCTGGAAAAGATGG

ACGGCACCGAGGAACTGCTCGTGAAGCTGAACAGAGAGGACCTGCTGCGGAAGCAGCGGACCTTCGACAA

CGGCAGCATCCCCCACCAGATCCACCTGGGAGAGCTGCACGCCATTCTGCGGCGGCAGGAAGATTTTTAC

CCATTCCTGAAGGACAACCGGGAAAAGATCGAGAAGATCCTGACCTTCCGCATCCCCTACTACGTGGGCC

CTCTGGCCAGGGGAAACAGCAGATTCGCCTGGATGACCAGAAAGAGCGAGGAAACCATCACCCCCTGGAA

CTTCGAGGAAGTGGTGGACAAGGGCGCTTCCGCCCAGAGCTTCATCGAGCGGATGACCAACTTCGATAAG

AACCTGCCCAACGAGAAGGTGCTGCCCAAGCACAGCCTGCTGTACGAGTACTTCACCGTGTATAACGAGC

TGACCAAAGTGAAATACGTGACCGAGGGAATGAGAAAGCCCGCCTTCCTGAGCGGCGAGCAGAAAAAGGC

CATCGTGGACCTGCTGTTCAAGACCAACCGGAAAGTGACCGTGAAGCAGCTGAAAGAGGACTACTTCAAG

AAAATCGAGTGCTTCGACTCCGTGGAAATCTCCGGCGTGGAAGATCGGTTCAACGCCTCCCTGGGCACAT

ACCACGATCTGCTGAAAATTATCAAGGACAAGGACTTCCTGGACAATGAGGAAAACGAGGACATTCTGGA

AGATATCGTGCTGACCCTGACACTGTTTGAGGACAGAGAGATGATCGAGGAACGGCTGAAAACCTATGCC

CACCTGTTCGACGACAAAGTGATGAAGCAGCTGAAGCGGCGGAGATACACCGGCTGGGGCAGGCTGAGCC

GGAAGCTGATCAACGGCATCCGGGACAAGCAGTCCGGCAAGACAATCCTGGATTTCCTGAAGTCCGACGG

CTTCGCCAACAGAAACTTCATGCAGCTGATCCACGACGACAGCCTGACCTTTAAAGAGGACATCCAGAAA

GCCCAGGTGTCCGGCCAGGGCGATAGCCTGCACGAGCACATTGCCAATCTGGCCGGCAGCCCCGCCATTA

AGAAGGGCATCCTGCAGACAGTGAAGGTGGTGGACGAGCTCGTGAAAGTGATGGGCCGGCACAAGCCCGA

GAACATCGTGATCGAAATGGCCAGAGAGAACCAGACCACCCAGAAGGGACAGAAGAACAGCCGCGAGAGA

ATGAAGCGGATCGAAGAGGGCATCAAAGAGCTGGGCAGCCAGATCCTGAAAGAACACCCCGTGGAAAACA

CCCAGCTGCAGAACGAGAAGCTGTACCTGTACTACCTGCAGAATGGGCGGGATATGTACGTGGACCAGGA

ACTGGACATCAACCGGCTGTCCGACTACGATGTGGACCATATCGTGCCTCAGAGCTTTCTGAAGGACGAC

TCCATCGACAACAAGGTGCTGACCAGAAGCGACAAGAACCGGGGCAAGAGCGACAACGTGCCCTCCGAAG

AGGTCGTGAAGAAGATGAAGAACTACTGGCGGCAGCTGCTGAACGCCAAGCTGATTACCCAGAGAAAGTT

CGACAATCTGACCAAGGCCGAGAGAGGCGGCCTGAGCGAACTGGATAAGGCCGGCTTCATCAAGAGACAG

CTGGTGGAAACCCGGCAGATCACAAAGCACGTGGCACAGATCCTGGACTCCCGGATGAACACTAAGTACG

ACGAGAATGACAAGCTGATCCGGGAAGTGAAAGTGATCACCCTGAAGTCCAAGCTGGTGTCCGATTTCCG

GAAGGATTTCCAGTTTTACAAAGTGCGCGAGATCAACAACTACCACCACGCCCACGACGCCTACCTGAAC
```

-continued

```
GCCGTCGTGGGAACCGCCCTGATCAAAAAGTACCCTAAGCTGGAAAGCGAGTTCGTGTACGGCGACTACA

AGGTGTACGACGTGCGGAAGATGATCGCCAAGAGCGAGCAGGAAATCGGCAAGGCTACCGCCAAGTACTT

CTTCTACAGCAACATCATGAACTTTTTTCAAGACCGAGATTACCCTGGCCAACGGCGAGATCCGGAAGCGG

CCTCTGATCGAGACAAACGGCGAAACCGGGGAGATCGTGTGGGATAAGGGCCGGGATTTTGCCACCGTGC

GGAAAGTGCTGAGCATGCCCCAAGTGAATATCGTGAAAAAGACCGAGGTGCAGACAGGCGGCTTCAGCAA

AGAGTCTATCCTGCCCAAGAGGAACAGCGATAAGCTGATCGCCAGAAAGAAGGACTGGGACCCTAAGAAG

TACGGCGGCTTCGACAGCCCCACCGTGGCCTATTCTGTGCTGGTGGTGGCCAAAGTGGAAAAGGGCAAGT

CCAAGAAACTGAAGAGTGTGAAAGAGCTGCTGGGGATCACCATCATGGAAAGAAGCAGCTTCGAGAAGAA

TCCCATCGACTTTCTGGAAGCCAAGGGCTACAAAGAAGTGAAAAAGGACCTGATCATCAAGCTGCCTAAG

TACTCCCTGTTCGAGCTGGAAAACGGCCGGAAGAGAATGCTGGCCTCTGCCGGCGAACTGCAGAAGGGAA

ACGAACTGGCCCTGCCCTCCAAATATGTGAACTTCCTGTACCTGGCCAGCCACTATGAGAAGCTGAAGGG

CTCCCCCGAGGATAATGAGCAGAAACAGCTGTTTGTGGAACAGCACAAGCACTACCTGGACGAGATCATC

GAGCAGATCAGCGAGTTCTCCAAGAGAGTGATCCTGGCCGACGCTAATCTGGACAAAGTGCTGTCCGCCT

ACAACAAGCACCGGGATAAGCCCATCAGAGAGCAGGCCGAGAATATCATCCACCTGTTTACCCTGACCAA

TCTGGGAGCCCCTGCCGCCTTCAAGTACTTTGACACCACCATCGACCGGAAGAGGTACACCAGCACCAAA

GAGGTGCTGGACGCCACCCTGATCCACCAGAGCATCACCGGCCTGTACGAGACACGGATCGACCTGTCTC

AGCTGGGAGGTGACTCTGGCGGCTCAAAAAGAACCGCCGACGGCAGCGAATTCGAGCCCAAGAAGAAGAG

GAAAGTCTAACCGGTCATCATCACCATCACCATTGAGTTTAAACCCGCTGATCAGCCTCGACTGTGCCTT

CTAGTTGCCAGCCATCTGTTGTTTGCCCCTCCCCCGTGCCTTCCTTGACCCTGGAAGGTGCCACTCCCAC

TGTCCTTTCCTAATAAAATGAGGAAATTGCATCGCATTGTCTGAGTAGGTGTCATTCTATTCTGGGGGGT

GGGGTGGGGCAGGACAGCAAGGGGGAGGATTGGGAAGACAATAGCAGGCATGCTGGGGATGCGGTGGGCT

CTATGGCTTCTGAGGCGGAAAGAACCAGCTGGGGCTCGATACCGTCGACCTCTAGCTAGAGCTTGGCGTA

ATCATGGTCATAGCTGTTTCCTGTGTGAAATTGTTATCCGCTCACAATTCCACACAACATACGAGCCGGA

AGCATAAAGTGTAAAGCCTAGGGTGCCTAATGAGTGAGCTAACTCACATTAATTGCGTTGCGCTCACTGC

CCGCTTTCCAGTCGGGAAACCTGTCGTGCCAGCTGCATTAATGAATCGGCCAACGCGCGGGGAGAGGCGG

TTTGCGTATTGGGCGCTCTTCCGCTTCCTCGCTCACTGACTCGCTGCGCTCGGTCGTTCGGCTGCGGCGA

GCGGTATCAGCTCACTCAAAGGCGGTAATACGGTTATCCACAGAATCAGGGGATAACGCAGGAAAGAACA

TGTGAGCAAAAGGCCAGCAAAAGGCCAGGAACCGTAAAAAGGCCGCGTTGCTGGCGTTTTTCCATAGGCT

CCGCCCCCCTGACGAGCATCACAAAAATCGACGCTCAAGTCAGAGGTGGCGAAACCCGACAGGACTATAA

AGATACCAGGCGTTTCCCCCTGGAAGCTCCCTCGTGCGCTCTCCTGTTCCGACCCTGCCGCTTACCGGAT

ACCTGTCCGCCTTTCTCCCTTCGGGAAGCGTGGCGCTTTCTCATAGCTCACGCTGTAGGTATCTCAGTTC

GGTGTAGGTCGTTCGCTCCAAGCTGGGCTGTGTGCACGAACCCCCCGTTCAGCCCGACCGCTGCGCCTTA

TCCGGTAACTATCGTCTTGAGTCCAACCCGGTAAGACACGACTTATCGCCACTGGCAGCAGCCACTGGTA

ACAGGATTAGCAGAGCGAGGTATGTAGGCGGTGCTACAGAGTTCTTGAAGTGGTGGCCTAACTACGGCTA

CACTAGAAGAACAGTATTTGGTATCTGCGCTCTGCTGAAGCCAGTTACCTTCGGAAAAAGAGTTGGTAGC

TCTTGATCCGGCAAACAAACCACCGCTGGTAGCGGTGGTTTTTTTGTTTGCAAGCAGCAGATTACGCGCA

GAAAAAAAGGATCTCAAGAAGATCCTTTGATCTTTTCTACGGGGTCTGACACTCAGTGGAACGAAAACTC

ACGTTAAGGGATTTTGGTCATGAGATTATCAAAAAGGATCTTCACCTAGATCCTTTTAAATTAAAAATGA

AGTTTTAAATCAATCTAAAGTATATATGAGTAAACTTGGTCTGACAGTTACCAATGCTTAATCAGTGAGG

CACCTATCTCAGCGATCTGTCTATTTCGTTCATCCATAGTTGCCTGACTCCCCGTCGTGTAGATAACTAC

GATACGGGAGGGCTTACCATCTGGCCCCAGTGCTGCAATGATACCGCGAGACCCACGCTCACCGGCTCCA
```

-continued

```
GATTTATCAGCAATAAACCAGCCAGCCGGAAGGGCCGAGCGCAGAAGTGGTCCTGCAACTTTATCCGCCT

CCATCCAGTCTATTAATTGTTGCCGGGAAGCTAGAGTAAGTAGTTCGCCAGTTAATAGTTTGCGCAACGT

TGTTGCCATTGCTACAGGCATCGTGGTGTCACGCTCGTCGTTTGGTATGGCTTCATTCAGCTCCGGTTCC

CAACGATCAAGGCGAGTTACATGATCCCCCATGTTGTGCAAAAAAGCGGTTAGCTCCTTCGGTCCTCCGA

TCGTTGTCAGAAGTAAGTTGGCCGCAGTGTTATCACTCATGGTTATGGCAGCACTGCATAATTCTCTTAC

TGTCATGCCATCCGTAAGATGCTTTTCTGTGACTGGTGAGTACTCAACCAAGTCATTCTGAGAATAGTGT

ATGCGGCGACCGAGTTGCTCTTGCCCGGCGTCAATACGGGATAATACCGCGCCACATAGCAGAACTTTAA

AAGTGCTCATCATTGGAAAACGTTCTTCGGGGCGAAAACTCTCAAGGATCTTACCGCTGTTGAGATCCAG

TTCGATGTAACCCACTCGTGCACCCAACTGATCTTCAGCATCTTTTACTTTCACCAGCGTTTCTGGGTGA

GCAAAAACAGGAAGGCAAAATGCCGCAAAAAAGGGAATAAGGGCGACACGGAAATGTTGAATACTCATAC

TCTTCCTTTTTCAATATTATTGAAGCATTTATCAGGGTTATTGTCTCATGAGCGGATACATATTTGAATG

TATTTAGAAAAATAAACAAATAGGGGTTCCGCGCACATTTCCCCGAAAAGTGCCACCTGACGTCGACGGA

TCGGGAGATCGATCTCCCGATCCCCTAGGGTCGACTCTCAGTACAATCTGCTCTGATGCCGCATAGTTAA

GCCAGTATCTGCTCCCTGCTTGTGTGTTGGAGGTCGCTGAGTAGTGCGCGAGCAAAATTTAAGCTACAAC

AAGGCAAGGCTTGACCGACAATTGCATGAAGAATCTGCTTAGGGTTAGGCGTTTTGCGCTGCTTCGCGAT

GTACGGGCCAGATATACGCGTTGACATTGATTATTGACTAGTTATTAATAGTAATCAATTACGGGGTCAT

TAGTTCATAGCCCATATATGGAGTTCCGCGTTACATAACTTACGGTAAATGGCCCGCCTGGCTGACCGCC

CAACGACCCCCGCCCATTGACGTCAATAATGACGTATGTTCCCATAGTAACGCCAATAGGGACTTTCCAT

TGACGTCAATGGGTGGAGTATTTACGGTAAACTGCCCACTTGGCAGTACATCAAGTGTATC
```

By "base editing activity" is meant acting to chemically alter a base within a polynucleotide. In one embodiment, a first base is converted to a second base. In one embodiment, the base editing activity is cytidine deaminase activity, e.g., converting target C•G to T•A. In another embodiment, the base editing activity is adenosine or adenine deaminase activity, e.g., converting A•T to G•C. In another embodiment, the base editing activity is cytidine deaminase activity, e.g., converting target C•G to T•A and adenosine or adenine deaminase activity, e.g., converting A•T to G•C. In some embodiments, base editing activity is assessed by efficiency of editing. Base editing efficiency may be measured by any suitable means, for example, by sanger sequencing or next generation sequencing. In some embodiments, base editing efficiency is measured by percentage of total sequencing reads with nucleobase conversion effected by the base editor, for example, percentage of total sequencing reads with target A.T base pair converted to a G.C base pair. In some embodiments, base editing efficiency is measured by percentage of total cells with nucleobase conversion effected by the base editor, when base editing is performed in a population of cells.

The term "base editor system" refers to a system for editing a nucleobase of a target nucleotide sequence. In various embodiments, the base editor system comprises (1) a polynucleotide programmable nucleotide binding domain (e.g. Cas9); (2) a deaminase domain (e.g. an adenosine deaminase or a cytidine deaminase) for deaminating said nucleobase; and (3) one or more guide polynucleotide (e.g., guide RNA). In some embodiments, the polynucleotide programmable nucleotide binding domain is a polynucleotide programmable DNA binding domain. In some embodiments, the base editor is an adenine or adenosine base editor (ABE). In some embodiments, the base editor system is ABE8.

In some embodiments, a base editor system may comprise more than one base editing component. For example, a base editor system may include more than one deaminase. In some embodiments, a base editor system may include one or more adenosine deaminases. In some embodiments, a single guide polynucleotide may be utilized to target different deaminases to a target nucleic acid sequence. In some embodiments, a single pair of guide polynucleotides may be utilized to target different deaminases to a target nucleic acid sequence.

The deaminase domain and the polynucleotide programmable nucleotide binding component of a base editor system may be associated with each other covalently or non-covalently, or any combination of associations and interactions thereof. For example, in some embodiments, a deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the deaminase domain can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or an RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the deaminase domain can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a BER inhibitor. In some embodiments, the inhibitor of BER can be a uracil DNA glycosylase inhibitor (UGI). In some embodiments, the inhibitor of BER can be an inosine BER inhibitor. In some embodiments, the inhibitor of BER can be targeted to the target nucleotide sequence by the polynucleotide programmable nucleotide binding domain. In some embodiments, a polynucleotide programmable nucleotide binding domain can be fused or linked to an inhibitor of BER. In some embodiments, a polynucleotide programmable nucleotide binding domain can be fused or linked to a deaminase domain and an inhibitor of BER. In some embodiments, a polynucleotide programmable nucleotide binding domain can target an inhibitor of BER to a target nucleotide sequence by non-covalently interacting with or associating with the inhibitor of BER. For example, in some embodiments, the inhibitor of BER component can comprise an additional heterologous portion or domain that is capable of interacting with, associating with, or capable of forming a complex with an additional heterologous portion or domain that is part of a polynucleotide programmable nucleotide binding domain.

In some embodiments, the inhibitor of BER can be targeted to the target nucleotide sequence by the guide polynucleotide. For example, in some embodiments, the inhibitor of BER can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of BER. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif.

By "B cell maturation antigen, or tumor necrosis factor receptor superfamily member 17 polypeptide, (BCMA)" is meant a protein having at least about 85% amino acid sequence identify to NCBI Accession No. NP_001183 or a fragment thereof that is expressed on mature B lymphocytes. An exemplary BCMA polypeptide sequence is provided below.

```
>NP_001183.2 tumor necrosis factor receptor
superfamily member 17 [Homo sapiens]
                              (SEQ ID NO: 18)
MLQMAGQCSQNEYFDSLLHACIPCQLRCSSNTPPLTCQRYCNASVTNSVK

GTNAILWTCLGLSLIISLAVFVLMFLLRKINSEPLKDEFKNTGSGLLGMA

NIDLEKSRTGDEIILPRGLEYTVEECTCEDCIKSKPKVDSDHCFPLPAME

EGATILVTTKTNDYCKSLPAALSATEIEKSISAR
```

This antigen can be targeted in relapsed or refractory multiple myeloma and other hematological neoplasia therapies.

By "B cell maturation antigen, or tumor necrosis factor receptor superfamily member 17, (BCMA) polynucleotide" is meant a nucleic acid molecule encoding a BCMA polypeptide. The BCMA gene encodes a cell surface receptor that recognizes B cell activating factor. An exemplary B2M polynucleotide sequence is provided below.

>NM_001192.2 *Homo sapiens* TNF receptor
superfamily member 17 (TNFRSF17), mRNA (SEQ ID NO: 19)

AAGACTCAAACTTAGAAACTTGAATTAGATGTGGTATTCAAATCCTTAGC

TGCCGCGAAGACACAGACAGCCCCCGTAAGAACCCACGAAGCAGGCGAAG

TTCATTGTTCTCAACATTCTAGCTGCTCTTGCTGCATTTGCTCTGGAATT

CTTGTAGAGATATTACTTGTCCTTCCAGGCTGTTCTTTCTGTAGCTCCCT

TGTTTTCTTTTTGTGATCATGTTGCAGATGGCTGGGCAGTGCTCCCAAAA

TGAATATTTTGACAGTTTGTTGCATGCTTGCATACCTTGTCAACTTCGAT

GTTCTTCTAATACTCCTCCTCTAACATGTCAGCGTTATTGTAATGCAAGT

GTGACCAATTCAGTGAAAGGAACGAATGCGATTCTCTGGACCTGTTTGGG

ACTGAGCTTAATAATTTCTTTGGCAGTTTTCGTGCTAATGTTTTTGCTAA

GGAAGATAAACTCTGAACCATTAAAGGACGAGTTTAAAAACACAGGATCA

GGTCTCCTGGGCATGGCTAACATTGACCTGGAAAAGAGCAGGACTGGTGA

TGAAATTATTCTTCCGAGAGGCCTCGAGTACACGGTGGAAGAATGCACCT

GTGAAGACTGCATCAAGAGCAAACCGAAGGTCGACTCTGACCATTGCTTT

CCACTCCCAGCTATGGAGGAAGGCGCAACCATTCTTGTCACCACGAAAAC

GAATGACTATTGCAAGAGCCTGCCAGCTGCTTTGAGTGCTACGGAGATAG

AGAAATCAATTTCTGCTAGGTAATTAACCATTTCGACTCGAGCAGTGCCA

-continued

CTTTAAAAATCTTTTGTCAGAATAGATGATGTGTCAGATCTCTTTAGGAT

GACTGTATTTTTCAGTTGCCGATACAGCTTTTTGTCCTCTAACTGTGGAA

ACTCTTTATGTTAGATATATTTCTCTAGGTTACTGTTGGGAGCTTAATGG

TAGAAACTTCCTTGGTTTCATGATTAAACTCTTTTTTTTCCTGA

By "beta-2 microglobulin (B2M) polypeptide" is meant a protein having at least about 85% amino acid sequence identity to UniProt Accession No. P61769 or a fragment thereof and having immunomodulatory activity. An exemplary B2M polypeptide sequence is provided below.

>sp|P61769|B2MG_HUMAN Beta-2-microglobulin
OS = Homo sapiens OX = 9606 GN = B2M
PE = 1 SV = 1

(SEQ ID NO: 20)

MSRSVALAVLALLSLSGLEAIQRTPKIQVYSRHPAENGKSNFLNCYVSGF

HPSDIEVDLLKNGERIEKVEHSDLSFSKDWSFYLLYYTEFTPTEKDEYAC

RVNHVTLSQPKIVKWDRDM

By "beta-2-microglobulin (B2M) polynucleotide" is meant a nucleic acid molecule encoding a B2M polypeptide. The beta-2-microglobulin gene encodes a serum protein associated with the major histocompatibility complex. B2M is involved in non-self recognition by host CD8+ T cells. An exemplary B2M polynucleotide sequence is provided below.

>DQ217933.1 *Homo sapiens* beta-2-microglobin (B2M) gene,
complete cds (SEQ ID NO: 21)

CATGTCATAAATGGTAAGTCCAAGAAAAATACAGGTATTCCCCCCCAAAGAAAACTG

TAAAATCGACTTTTTTCTATCTGTACTGTTTTTTATTGGTTTTTAAATTGGTTTTCCAAGTG

AGTAAATCAGAATCTATCTGTAATGGATTTTAAATTTAGTGTTTCTCTGTGATGTAGTAAAC

AAGAAACTAGAGGCAAAAATAGCCCTGTCCCTTGCTAAACTTCTAAGGCACTTTTCTAGTAC

AACTCAACACTAACATTTCAGGCCTTTAGTGCCTTATATGAGTTTTTAAAAGGGGGAAAAGG

GAGGGAGCAAGAGTGTCTTAACTCATACATTTAGGCATAACAATTATTCTCATATTTTAGTT

ATTGAGAGGGCTGGTAGAAAAACTAGGTAAATAATATTAATAATTATAGCGCTTATTAAACA

CTACAGAACACTTACTATGTACCAGGCATTGTGGGAGGCTCTCTCTTGTGCATTATCTCATT

TCATTAGGTCCATGGAGAGTATTGCATTTTCTTAGTTTAGGCATGGCCTCCACAATAAAGAT

TATCAAAAGCCTAAAAATATGTAAAAGAAACCTAGAAGTTATTTGTTGTGCTCCTTGGGGAA

GCTAGGCAAATCCTTTCAACTGAAAACCATGGTGACTTCCAAGATCTCTGCCCCTCCCCATC

GCCATGGTCCACTTCCTCTTCTCACTGTTCCTCTTAGAAAAGATCTGTGGACTCCACCACCA

CGAAATGGCGGCACCTTATTTATGGTCACTTTAGAGGGTAGGTTTTCTTAATGGGTCTGCCT

GTCATGTTTAACGTCCTTGGCTGGGTCCAAGGCAGATGCAGTCCAAACTCTCACTAAAATTG

CCGAGCCCTTTGTCTTCCAGTGTCTAAAATATTAATGTCAATGGAATCAGGCCAGAGTTTGA

ATTCTAGTCTCTTAGCCTTTGTTTCCCCTGTCCATAAAATGAATGGGGGTAATTCTTTCCTC

CTACAGTTTATTTATATATTCACTAATTCATTCATTCATCCATCCATTCGTTCATTCGGTTT

ACTGAGTACCTACTATGTGCCAGCCCCTGTTCTAGGGTGGAAACTAAGAGAATGATGTACCT

AGAGGGCGCTGGAAGCTCTAAAGCCCTAGCAGTTACTGCTTTTACTATTAGTGGTCGTTTTT

TTCTCCCCCCGCCCCCCGACAAATCAACAGAACAAAGAAAATTACCTAAACAGCAAGGACA

-continued

```
TAGGGAGGAACTTCTTGGCACAGAACTTTCCAAACACTTTTTCCTGAAGGGATACAAGAAGC

AAGAAAGGTACTCTTTCACTAGGACCTTCTCTGAGCTGTCCTCAGGATGCTTTTGGGACTAT

TTTTCTTACCCAGAGAATGGAGAAACCCTGCAGGGAATTCCCAAGCTGTAGTTATAAACAGA

AGTTCTCCTTCTGCTAGGTAGCATTCAAAGATCTTAATCTTCTGGGTTTCCGTTTTCTCGAA

TGAAAAATGCAGGTCCGAGCAGTTAACTGGCTGGGGCACCATTAGCAAGTCACTTAGCATCT

CTGGGGCCAGTCTGCAAAGCGAGGGGGCAGCCTTAATGTGCCTCCAGCCTGAAGTCCTAGAA

TGAGCGCCCGGTGTCCCAAGCTGGGGCGCGCACCCCAGATCGGAGGGCGCCGATGTACAGAC

AGCAAACTCACCCAGTCTAGTGCATGCCTTCTTAAACATCACGAGACTCTAAGAAAAGGAAA

CTGAAAACGGGAAAGTCCCTCTCTCTAACCTGGCACTGCGTCGCTGGCTTGGAGACAGGTGA

CGGTCCCTGCGGGCCTTGTCCTGATTGGCTGGGCACGCGTTTAATATAAGTGGAGGCGTCGC

GCTGGCGGGCATTCCTGAAGCTGACAGCATTCGGGCCGAGATGTCTCGCTCCGTGGCCTTAG

CTGTGCTCGCGCTACTCTCTCTTTCTGGCCTGGAGGCTATCCAGCGTGAGTCTCTCCTACCC

TCCCGCTCTGGTCCTTCCTCTCCCGCTCTGCACCCTCTGTGGCCCTCGCTGTGCTCTCTCGC

TCCGTGACTTCCCTTCTCCAAGTTCTCCTTGGTGGCCCGCCGTGGGGCTAGTCCAGGGCTGG

ATCTCGGGGAAGCGGCGGGGTGGCCTGGGAGTGGGGAAGGGGGTGCGCACCCGGGACGCGCG

CTACTTGCCCCTTTCGGCGGGGAGCAGGGGAGACCTTTGGCCTACGGCGACGGGAGGGTCGG

GACAAAGTTTAGGGCGTCGATAAGCGTCAGAGCGCCGAGGTTGGGGGAGGGTTTCTCTTCCG

CTCTTTCGCGGGGCCTCTGGCTCCCCCAGCGCAGCTGGAGTGGGGGACGGGTAGGCTCGTCC

CAAAGGCGCGGCGCTGAGGTTTGTGAACGCGTGGAGGGGCGCTTGGGGTCTGGGGGAGGCGT

CGCCCGGGTAAGCCTGTCTGCTGCGGCTCTGCTTCCCTTAGACTGGAGAGCTGTGGACTTCG

TCTAGGCGCCCGCTAAGTTCGCATGTCCTAGCACCTCTGGGTCTATGTGGGGCCACACCGTG

GGGAGGAAACAGCACGCGACGTTTGTAGAATGCTTGGCTGTGATACAAAGCGGTTTCGAATA

ATTAACTTATTTGTTCCCATCACATGTCACTTTTAAAAAATTATAAGAACTACCCGTTATTG

ACATCTTTCTGTGTGCCAAGGACTTTATGTGCTTTGCGTCATTTAATTTTGAAAACAGTTAT

CTTCCGCCATAGATAACTACTATGGTTATCTTCTGCCTCTCACAGATGAAGAAACTAAGGCA

CCGAGATTTTAAGAAACTTAATTACACAGGGGATAAATGGCAGCAATCGAGATTGAAGTCAA

GCCTAACCAGGGCTTTTGCGGGAGCGCATGCCTTTTGGCTGTAATTCGTGCATTTTTTTTTA

AGAAAAACGCCTGCCTTCTGCGTGAGATTCTCCAGAGCAAACTGGGCGGCATGGGCCCTGTG

GTCTTTTCGTACAGAGGGCTTCCTCTTTGGCTCTTTGCCTGGTTGTTTCCAAGATGTACTGT

GCCTCTTACTTTCGGTTTTGAAAACATGAGGGGGTTGGGCGTGGTAGCTTACGCCTGTAATC

CCAGCACTTAGGGAGGCCGAGGCGGGAGGATGGCTTGAGGTCCGTAGTTGAGACCAGCCTGG

CCAACATGGTGAAGCCTGGTCTCTACAAAAAATAATAACAAAAATTAGCCGGGTGTGGTGGC

TCGTGCCTGTGGTCCCAGCTGCTCCGGTGGCTGAGGCGGGAGGATCTCTTGAGCTTAGGCTT

TTGAGCTATCATGGCGCCAGTGCACTCCAGCGTGGGCAACAGAGCGAGACCCTGTCTCTCAA

AAAGAAAAAAAAAAAAAAAGAAAGAGAAAAGAAAAGAAAGAAAGAAGTGAAGGTTTGTCAG

TCAGGGGAGCTGTAAAACCATTAATAAAGATAATCCAAGATGGTTACCAAGACTGTTGAGGA

CGCCAGAGATCTTGAGCACTTTCTAAGTACCTGGCAATACACTAAGCGCGCTCACCTTTTCC

TCTGGCAAAACATGATCGAAAGCAGAATGTTTTGATCATGAGAAAATTGCATTTAATTTGAA

TACAATTTATTTACAACATAAAGGATAATGTATATATCACCACCATTACTGGTATTTGCTGG

TTATGTTAGATGTCATTTTAAAAAATAACAATCTGATATTTAAAAAAAAATCTTATTTTGAA

AATTTCCAAAGTAATACATGCCATGCATAGACCATTTCTGGAAGATACCACAAGAAACATGT
```

-continued

```
AATGATGATTGCCTCTGAAGGTCTATTTTCCTCCTCTGACCTGTGTGTGGGTTTTGTTTTTG

TTTTACTGTGGGCATAAATTAATTTTTCAGTTAAGTTTTGGAAGCTTAAATAACTCTCCAAA

AGTCATAAAGCCAGTAACTGGTTGAGCCCAAATTCAAACCCAGCCTGTCTGATACTTGTCCT

CTTCTTAGAAAAGATTACAGTGATGCTCTCACAAAATCTTGCCGCCTTCCCTCAAACAGAGA

GTTCCAGGCAGGATGAATCTGTGCTCTGATCCCTGAGGCATTTAATATGTTCTTATTATTAG

AAGCTCAGATGCAAAGAGCTCTCTTAGCTTTTAATGTTATGAAAAAAATCAGGTCTTCATTA

GATTCCCCAATCCACCTCTTGATGGGGCTAGTAGCCTTTCCTTAATGATAGGGTGTTTCTAG

AGAGATATATCTGGTCAAGGTGGCCTGGTACTCCTCCTTCTCCCCACAGCCTCCCAGACAAG

GAGGAGTAGCTGCCTTTTAGTGATCATGTACCCTGAATATAAGTGTATTTAAAAGAATTTTA

TACACATATATTTAGTGTCAATCTGTATATTTAGTAGCACTAACACTTCTCTTCATTTTCAA

TGAAAAATATAGAGTTTATAATATTTTCTTCCCACTTCCCCATGGATGGTCTAGTCATGCCT

CTCATTTTGGAAAGTACTGTTTCTGAAACATTAGGCAATATATTCCCAACCTGGCTAGTTTA

CAGCAATCACCTGTGGATGCTAATTAAAACGCAAATCCCACTGTCACATGCATTACTCCATT

TGATCATAATGGAAAGTATGTTCTGTCCCATTTGCCATAGTCCTCACCTATCCCTGTTGTAT

TTTATCGGGTCCAACTCAACCATTTAAGGTATTTGCCAGCTCTTGTATGCATTTAGGTTTTG

TTTCTTTGTTTTTTAGCTCATGAAATTAGGTACAAAGTCAGAGAGGGGTCTGGCATATAAAA

CCTCAGCAGAAATAAAGAGGTTTTGTTGTTTGGTAAGAACATACCTTGGGTTGGTTGGGCAC

GGTGGCTCGTGCCTGTAATCCCAACACTTTGGGAGGCCAAGGCAGGCTGATCACTTGAAGTT

GGGAGTTCAAGACCAGCCTGGCCAACATGGTGAAATCCCGTCTCTACTGAAAATACAAAAAT

TAACCAGGCATGGTGGTGTGTGCCTGTAGTCCCAGGAATCACTTGAACCCAGGAGGCGGAGG

TTGCAGTGAGCTGAGATCTCACCACTGCACACTGCACTCCAGCCTGGGCAATGGAATGAGAT

TCCATCCCAAAAAATAAAAAAATAAAAAAATAAAGAACATACCTTGGGTTGATCCACTTAGG

AACCTCAGATAATAACATCTGCCACGTATAGAGCAATTGCTATGTCCCAGGCACTCTACTAG

ACACTTCATACAGTTTAGAAAATCAGATGGGTGTAGATCAAGGCAGGAGCAGGAACCAAAAA

GAAAGGCATAAACATAAGAAAAAAAATGGAAGGGGTGGAAACAGAGTACAATAACATGAGTA

ATTTGATGGGGGCTATTATGAACTGAGAAATGAACTTTGAAAAGTATCTTGGGGCCAAATCA

TGTAGACTCTTGAGTGATGTGTTAAGGAATGCTATGAGTGCTGAGAGGGCATCAGAAGTCCT

TGAGAGCCTCCAGAGAAAGGCTCTTAAAAATGCAGCGCAATCTCCAGTGACAGAAGATACTG

CTAGAAATCTGCTAGAAAAAAAACAAAAAAGGCATGTATAGAGGAATTATGAGGGAAAGATA

CCAAGTCACGGTTTATTCTTCAAAATGGAGGTGGCTTGTTGGGAAGGTGGAAGCTCATTTGG

CCAGAGTGGAAATGGAATTGGGAGAAATCGATGACCAAATGTAAACACTTGGTGCCTGATAT

AGCTTGACACCAAGTTAGCCCCAAGTGAAATACCCTGGCAATATTAATGTGTCTTTTCCCGA

TATTCCTCAGGTACTCCAAAGATTCAGGTTTACTCACGTCATCCAGCAGAGAATGGAAAGTC

AAATTTCCTGAATTGCTATGTGTCTGGGTTTCATCCATCCGACATTGAAGTTGACTTACTGA

AGAATGGAGAGAGAATTGAAAAAGTGGAGCATTCAGACTTGTCTTTCAGCAAGGACTGGTCT

TTCTATCTCTTGTACTACACTGAATTCACCCCCACTGAAAAAGATGAGTATGCCTGCCGTGT

GAACCATGTGACTTTGTCACAGCCCAAGATAGTTAAGTGGGGTAAGTCTTACATTCTTTTGT

AAGCTGCTGAAAGTTGTGTATGAGTAGTCATATCATAAAGCTGCTTTGATATAAAAAAGGTC

TATGGCCATACTACCCTGAATGAGTCCCATCCCATCTGATATAAACAATCTGCATATTGGGA

TTGTCAGGGAATGTTCTTAAAGATCAGATTAGTGGCACCTGCTGAGATACTGATGCACAGCA
```

-continued

```
TGGTTTCTGAACCAGTAGTTTCCCTGCAGTTGAGCAGGGAGCAGCAGCAGCACTTGCACAAA

TACATATACACTCTTAACACTTCTTACCTACTGGCTTCCTCTAGCTTTTGTGGCAGCTTCAG

GTATATTTAGCACTGAACGAACATCTCAAGAAGGTATAGGCCTTTGTTTGTAAGTCCTGCTG

TCCTAGCATCCTATAATCCTGGACTTCTCCAGTACTTTCTGGCTGGATTGGTATCTGAGGCT

AGTAGGAAGGGCTTGTTCCTGCTGGGTAGCTCTAAACAATGTATTCATGGGTAGGAACAGCA

GCCTATTCTGCCAGCCTTATTTCTAACCATTTTAGACATTTGTTAGTACATGGTATTTTAAA

AGTAAAACTTAATGTCTTCCTTTTTTTTCTCCACTGTCTTTTTCATAGATCGAGACATGTAA

GCAGCATCATGGAGGTAAGTTTTTGACCTTGAGAAAATGTTTTTGTTTCACTGTCCTGAGGA

CTATTTATAGACAGCTCTAACATGATAACCCTCACTATGTGGAGAACATTGACAGAGTAACA

TTTTAGCAGGGAAAGAAGAATCCTACAGGGTCATGTTCCCTTCTCCTGTGGAGTGGCATGAA

GAAGGTGTATGGCCCCAGGTATGGCCATATTACTGACCCTCTACAGAGAGGGCAAAGGAACT

GCCAGTATGGTATTGCAGGATAAAGGCAGGTGGTTACCCACATTACCTGCAAGGCTTTGATC

TTTCTTCTGCCATTTCCACATTGGACATCTCTGCTGAGGAGAGAAAATGAACCACTCTTTTC

CTTTGTATAATGTTGTTTTATTCTTCAGACAGAAGAGAGGAGTTATACAGCTCTGCAGACAT

CCCATTCCTGTATGGGGACTGTGTTTGCCTCTTAGAGGTTCCCAGGCCACTAGAGGAGATAA

AGGGAAACAGATTGTTATAACTTGATATAATGATACTATAATAGATGTAACTACAAGGAGCT

CCAGAAGCAAGAGAGAGGGAGGAACTTGGACTTCTCTGCATCTTTAGTTGGAGTCCAAAGGC

TTTTCAATGAAATTCTACTGCCCAGGGTACATTGATGCTGAAACCCCATTCAAATCTCCTGT

TATATTCTAGAACAGGGAATTGATTTGGGAGAGCATCAGGAAGGTGGATGATCTGCCCAGTC

ACACTGTTAGTAAATTGTAGAGCCAGGACCTGAACTCTAATATAGTCATGTGTTACTTAATG

ACGGGGACATGTTCTGAGAAATGCTTACACAAACCTAGGTGTTGTAGCCTACTACACGCATA

GGCTACATGGTATAGCCTATTGCTCCTAGACTACAAACCTGTACAGCCTGTTACTGTACTGA

ATACTGTGGGCAGTTGTAACACAATGGTAAGTATTTGTGTATCTAAACATAGAAGTTGCAGT

AAAAATATGCTATTTTAATCTTATGAGACCACTGTCATATATACAGTCCATCATTGACCAAA

ACATCATATCAGCATTTTTTCTTCTAAGATTTTGGGAGCACCAAAGGGATACACTAACAGGA

TATACTCTTTATAATGGGTTTGGAGAACTGTCTGCAGCTACTTCTTTTAAAAAGGTGATCTA

CACAGTAGAAATTAGACAAGTTTGGTAATGAGATCTGCAATCCAAATAAAATAAATTCATTG

CTAACCTTTTTCTTTTCTTTTCAGGTTTGAAGATGCCGCATTTGGATTGGATGAATTCCAAA

TTCTGCTTGCTTGCTTTTTAATATTGATATGCTTATACACTTACACTTTATGCACAAAATGT

AGGGTTATAATAATGTTAACATGGACATGATCTTCTTTATAATTCTACTTTGAGTGCTGTCT

CCATGTTTGATGTATCTGAGCAGGTTGCTCCACAGGTAGCTCTAGGAGGGCTGGCAACTTAG

AGGTGGGGAGCAGAGAATTCTCTTATCCAACATCAACATCTTGGTCAGATTTGAACTCTTCA

ATCTCTTGCACTCAAAGCTTGTTAAGATAGTTAAGCGTGCATAAGTTAACTTCCAATTTACA

TACTCTGCTTAGAATTTGGGGGAAAATTTAGAAATATAATTGACAGGATTATTGGAAATTTG

TTATAATGAATGAAACATTTTGTCATATAAGATTCATATTTACTTCTTATACATTTGATAAA

GTAAGGCATGGTTGTGGTTAATCTGGTTTATTTTTGTTCCACAAGTTAAATAAATCATAAAA

CTTGATGTGTTATCTCTTATATCTCACTCCCACTATTACCCCTTTATTTTCAAACAGGGAAA

CAGTCTTCAAGTTCCACTTGGTAAAAAATGTGAACCCCTTGTATATAGAGTTTGGCTCACAG

TGTAAAGGGCCTCAGTGATTCACATTTTCCAGATTAGGAATCTGATGCTCAAAGAAGTTAAA

TGGCATAGTTGGGGTGACACAGCTGTCTAGTGGGAGGCCAGCCTTCTATATTTTAGCCAGCG

TTCTTTCCTGCGGGCCAGGTCATGAGGAGTATGCAGACTCTAAGAGGGAGCAAAAGTATCTG
```

-continued

```
AAGGATTTAATATTTTAGCAAGGAATAGATATACAATCATCCCTTGGTCTCCCTGGGGGATT

GGTTTCAGGACCCCTTCTTGGACACCAAATCTATGGATATTTAAGTCCCTTCTATAAAATGG

TATAGTATTTGCATATAACCTATCCACATCCTCCTGTATACTTTAAATCATTTCTAGATTAC

TTGTAATACCTAATACAATGTAAATGCTATGCAAATAGTTGTTATTGTTTAAGGAATAATGA

CAAGAAAAAAAAGTCTGTACATGCTCAGTAAAGACACAACCATCCCTTTTTTTCCCCAGTGT

TTTTGATCCATGGTTTGCTGAATCCACAGATGTGGAGCCCCTGGATACGGAAGGCCCGCTGT

ACTTTGAATGACAAATAACAGATTTAAA
```

The term "Cas9" or "Cas9 domain" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a Casn1 nuclease or a CRISPR (clustered regularly interspaced short palindromic repeat) associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gRNA") can be engineered so as to incorporate aspects of both the crRNA and tracrRNA into a single RNA species. See, e.g., Jinek M., et al. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., Proc. Natl. Acad. Sci. U.S.A. 98:4658-4663(2001); "CRISPR RNA maturation by trans-encoded small RNA and host factor RNase III." Deltcheva E., et al., Nature 471:602-607(2011); and "A programmable dual-RNA-guided DNA endonuclease in adaptive bacterial immunity." Jinek M., et al., Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

An exemplary Cas9, is *Streptococcus pyogenes* Cas9 (spCas9), the amino acid sequence of which is provided below:

(SEQ ID NO: 22)

```
MDKKYSIGLDIGTNSVGWAVITDDYKVPSKKFKVLGNTDRHSIKKNLIGALLFGSGETAEAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQGHSLHEQIANLAGSPAIKKGILQTVKIV

DELVKVMGHKPENIVIEMARENQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN
```

```
                    -continued
VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD
```

(single underline: HNH domain; double underline: RuvC domain)

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, wild-type Cas9 corresponds to Cas9 from *Streptococcus pyogenes* (NCBI Reference Sequence: NC_017053.1, nucleotide and amino acid sequences as follows).

```
                                    (SEQ ID NO: 23)
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC
```

-continued

```
CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGATATTCAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAAATCTAAATTAGTTTCTGACTTCCGAAAAGATTTCCAATTCT

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA
```

-continued

```
AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC

AAAAAGGAAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTGGAGCAGCA

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA
```

(SEQ ID NO: 22)

```
MDKKYSIGLDIGTNSVGWAVITDDYKVPSKKFKVLGNTDRHSIKKNLIGALLFGSGETAEAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQGHSLHEQIANLAGSPAIKKGILQTVKIV

DELVKVMGHKPENIVIEMARENQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR
```

-continued

EQAENIIHLFTLTNLGAPAAFKYFDTTIDRKRYTSTKEVLDATLIHQSITGLYETRIDLSQL

GGD (single underline: HNH domain; double underline: RuvC domain)

In some embodiments, wild-type Cas9 corresponds to, or comprises the following nucleotide and/or amino acid sequences:

(SEQ ID NO: 24)

ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAAGTACCCAACGATTTATCACCTCAGAAAAAAGCTAGTTGACTC

AACTGATAAAGCGGACCTGAGGTTAATCTACTTGGCTCTTGCCCATATGATAAAGTTCCGTG

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

GATCTCCGGGGTAGAAGATCGATTTAATGCGTCACTTGGTACGTATCATGACCTCCTAAAGA

TAATTAAAGATAAGGACTTCCTGGATAACGAAGAGAATGAAGATATCTTAGAAGATATAGTG

TTGACTCTTACCCTCTTTGAAGATCGGGAAATGATTGAGGAAAGACTAAAAACATACGCTCA

CCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTT

-continued

```
CTAAAGAGCGACGGCTTCGCCAATAGGAACTTTATGCAGCTGATCCATGATGACTCTTTAAC

CTTCAAAGAGGATATACAAAAGGCACAGGTTTCCGGACAAGGGGACTCATTGCACGAACATA

TTGCGAATCTTGCTGGTTCGCCAGCCATCAAAAAGGGCATACTCCAGACAGTCAAAGTAGTG

GATGAGCTAGTTAAGGTCATGGGACGTCACAAACCGGAAAACATTGTAATCGAGATGGCACG

CGAAAATCAAACGACTCAGAAGGGGCAAAAAAACAGTCGAGAGCGGATGAAGAGAATAGAAG

AGGGTATTAAAGAACTGGGCAGCCAGATCTTAAAGGAGCATCCTGTGGAAAATACCCAATTG

CAGAACGAGAAACTTTACCTCTATTACCTACAAAATGGAAGGGACATGTATGTTGATCAGGA

ACTGGACATAAACCGTTTATCTGATTACGACGTCGATCACATTGTACCCCAATCCTTTTTGA

AGGACGATTCAATCGACAATAAAGTGCTTACACGCTCGGATAAGAACCGAGGGAAAAGTGAC

AATGTTCCAAGCGAGGAAGTCGTAAAGAAAATGAAGAACTATTGGCGGCAGCTCCTAAATGC

GAAACTGATAACGCAAAGAAAGTTCGATAACTTAACTAAAGCTGAGAGGGGTGGCTTGTCTG

AACTTGACAAGGCCGGATTTATTAAACGTCAGCTCGTGGAAACCCGCCAAATCACAAAGCAT

GTTGCACAGATACTAGATTCCCGAATGAATACGAAATACGACGAGAACGATAAGCTGATTCG

GGAAGTCAAAGTAATCACTTTAAAGTCAAAATTGGTGTCGGACTTCAGAAAGGATTTTCAAT

TCTATAAAGTTAGGGAGATAAATAACTACCACCATGCGCACGACGCTTATCTTAATGCCGTC

GTAGGGACCGCACTCATTAAGAAATACCCGAAGCTAGAAAGTGAGTTTGTGTATGGTGATTA

CAAAGTTTATGACGTCCGTAAGATGATCGCGAAAAGCGAACAGGAGATAGGCAAGGCTACAG

CCAAATACTTCTTTTATTCTAACATTATGAATTTCTTTAAGACGGAAATCACTCTGGCAAAC

GGAGAGATACGCAAACGACCTTTAATTGAAACCAATGGGGAGACAGGTGAAATCGTATGGGA

TAAGGGCCGGGACTICGCGACGGTGAGAAAAGTTTTGTCCATGCCCCAAGTCAACATAGTAA

AGAAAACTGAGGTGCAGACCGGAGGGTTTTCAAAGGAATCGATTCTTCCAAAAAGGAATAGT

GATAAGCTCATCGCTCGTAAAAAGGACTGGGACCCGAAAAAGTACGGTGGCTTCGATAGCCC

TACAGTTGCCTATTCTGTCCTAGTAGTGGCAAAAGTTGAGAAGGGAAAATCCAAGAAACTGA

AGTCAGTCAAAGAATTATTGGGGATAACGATTATGGAGCGCTCGTCTTTTGAAAAGAACCCC

ATCGACTTCCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGCCGGAGAGC

TTCAAAAGGGGAACGAACTCGCACTACCGTCTAAATACGTGAATTTCCTGTATTTAGCGTCC

CATTACGAGAAGTTGAAAGGTTCACCTGAAGATAACGAACAGAAGCAACTTTTTGTTGAGCA

GCACAAACATTATCTCGACGAAATCATAGAGCAAATTTCGGAATTCAGTAAGAGAGTCATCC

TAGCTGATGCCAATCTGGACAAAGTATTAAGCGCATACAACAAGCACAGGGATAAACCCATA

CGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAG

ACGCGACACTGATTCACCAATCCATCACGGGATTATATGAAACTCGGATAGATTTGTCACAG

CTTGGGGGTGACGGATCCCCCAAGAAGAAGAGGAAAGTCTCGAGCGACTACAAAGACCATGA

CGGTGATTATAAAGATCATGACATCGATTACAAGGATGACGATGACAAGGCTGCAGGA
```

(SEQ ID NO: 25)

MDKK<u>YSIGLAIGTNSVGWAVITDEYKVPSKKFKVLGNTDRHSIKKNLIGALLFDSGET</u>AEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

-continued

```
EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```

(single underline: HNH domain; double underline: RuvC domain)

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

(SEQ ID NO: 26)

```
ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAATCTTATAGGGGCTCTTTTATTTGACAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT
```

-continued

```
TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAAATCCG

ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT
```

-continued

```
TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA

MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```

(SEQ ID NO: 1. single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, the Cas9 is from *Neisseria meningitidis* (Nme). In some embodiments, the Cas9 is Nme1, Nme2 or Nme3. In some embodiments, the PAM-interacting domains for Nme1, Nme2 or Nme3 are N4GAT, N4CC, and N4CAAA, respectively (see e.g., Edraki, A., et al., A Compact, High-Accuracy Cas9 with a Dinucleotide PAM for In Vivo Genome Editing, Molecular Cell (2018)). An exemplary *Neisseria meningitidis* Cas9 protein, Nme1Cas9, (NCBI Reference: WP_002235162.1; type II CRISPR RNA-guided endonuclease Cas9) has the following amino acid sequence:

```
                                        (SEQ ID NO: 27)
    1 maafkpnpin yilgldigia svgwamveid edenpiclid
      lgvrvferae vpktgdslam 61 arrlarsvrr ltrrrahrll rarrllkreg vlqaadfden
      glikslpntp wqlraaaldr 121 kltplewsav llhlikhrgy lsqrkneget adkelgallk
      gvadnahalq tgdfrtpael 181 alnkfekesg hirnqrgdys htfsrkdlqa elillfekqk
      efgnphvsgg lkegietllm 241 tqrpalsgda vqkmlghctf epaepkaakn tytaerfiwl
      tklnnlrile qgserpltdt 301 eratlmdepy rkskltyaqa rkllgledta ffkglrygkd
      naeastlmem kayhaisral 361 ekeglkdkks pinlspelqd eigtafslfk tdeditgrlk
      driqpeilea llkhisfdkf 421 vqislkalrr ivplmeqgkr ydeacaeiyg dhygkkntee
      kiylppipad eirnpvvlra 481 lsgarkving vvrrygspar ihietarevg ksfkdrkeie
      krqeenrkdr ekaaakfrey 541 fpnfvgepks kdilklrlye qqhgkclysg keinlgrine
      kgyveidhal pfsrtwddsf 601 nnkvlvlgse nqnkgnqtpy eyfngkdnsr ewqefkarve
      tsrfprskkq rillqkfded 661 gfkernlndt ryvnrflcqf vadrmrltgk gkkrvfasng
      gitnllrgfw glrkvraend 721 rhhaldavvv acstvamqqk itrfvrykem nafdgktidk
      etgevlhqkt hfpqpweffa 781 qevmirvfgk pdgkpefeea dtpeklrtll aeklssrpea
      vheyvtplfv srapnrkmsg 841 qghmetvksa krldegvsvl rvpltqlklk dlekmvnrer
      epklyealka rleahkddpa 901 kafaepfyky dkagnrtqqv kavrveqvqk tgvwvrnhng
      iadnatmvry dvfekgdkyy 961 lvpiyswqva kgilpdravv qgkdeedwql iddsfnfkfs
      lhpndlvevi tkkarmfgyf 1021 aschrgtgni nirihdldhk igkngilegi gvktalsfqk
      yqidelgkei rperlkkrpp 1081 vr
```

Another exemplary *Neisseria meningitidis* Cas9 protein, Nme2Cas9, (NCBI Reference: WP_002230835; type II CRISPR RNA-guided endonuclease Cas9) has the following amino acid sequence:

```
                                        (SEQ ID NO: 28)
    1 maafkpnpin yilgldigia svgwamveid eeenpirlid
      lgvrvferae vpktgdslam 61 arrlarsvrr ltrrrahrll rarrllkreg vlqaadfden
      glikslpntp wqlraaaldr
```

```
  121 kltplewsav llhlikhrgy lsqrkneget adkelgallk
      gvannahalq tgdfrtpael 181 alnkfekesg hirnqrgdys htfsrkdlqa elillfekqk
      efgnphvsgg lkegietllm 241 tqrpalsgda vqkmlghctf epaepkaakn tytaerfiwl
      tklnnlrile qgserpltdt 301 eratlmdepy rkskltyaqa rkllgledta ffkglrygkd
      naeastlmem kayhaisral 361 ekeglkdkks pinlsselqd eigtafslfk tdeditgrlk
      drvqpeilea llkhisfdkf 421 vqislkalrr ivplmeqgkr ydeacaeiyg dhygkkntee
      kiylppipad eirnpvvlra 481 lsgarkving vvrrygspar ihietarevg ksfkdrkeie
      krqeenrkdr ekaaakfrey 541 fpnfvgepks kdilklrlye qqhgkclysg keinlvrine
      kgyveidhal pfsrtwddsf 601 nnkvlvlgse nqnkgnqtpy eyfngkdnsr ewqefkarve
      tsrfprskkq rillqkfded 661 gfkecnlndt ryvnrflcqf vadhilltgk gkrrvfasng
      qitnllrgfw glrkvraend 721 rhhaldavvv acstvamqqk itrfvrykem nafdgktidk
      etgkvlhqkt hfpqpweffa 781 qevmirvfgk pdgkpefeea dtpeklrtll aeklssrpea
      vheyvtplfv srapnrkmsg 841 ahkdtlrsak rfvkhnekis vkrvwlteik ladlenmvny
      kngreielye alkarleayg 901 gnakqafdpk dnpfykkggq lvkavrvekt qesgvllnkk
      naytiadngd mvrvdvfckv 961 dkkgknqyfi vpiyawqvae nilpdidckg yriddsytfc
      fslhkydlia fqkdekskve 1021 fayyincdss ngrfylawhd kgskeqqfri stqnlvliqk
      yqvnelgkei rperlkkrpp 1081 vr
```

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

```
                                        (SEQ ID NO: 29)
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI
```

-continued

```
QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```

(single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

Exemplary catalytically inactive Cas9 (dCas9):

```
                                          (SEQ ID NO: 30)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY
```

-continued

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary catalytically Cas9 nickase (nCas9):

(SEQ ID NO: 31)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

-continued

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary catalytically active Cas9:

(SEQ ID NO: 32)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD.

In some embodiments, Cas9 refers to a Cas9 from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference.

Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In particular embodiments, napDNAbps useful in the methods of the invention include circular permutants, which are known in the art and described, for example, by Oakes et al., Cell 176, 254-267, 2019. An exemplary circular permutant follows where the bold sequence indicates sequence derived from Cas9, the italics sequence denotes a linker sequence, and the underlined sequence denotes a bipartite nuclear localization sequence, CP5 (with MSP "NGC=Pam Variant with mutations Regular Cas9 likes NGG" PID=Protein Interacting Domain and "D10A" nickase):

(SEQ ID NO: 5)
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFMQPTVAYSVLVVAKVEKGKSKKLKSVKELLGITIMERSSFEKN
PIDFLEAKGYKEVKKDLIIKLPKYSLFELENGRKRMLASAKFLQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPRAFKYF
DTTIARKEYRSTKEVLDATLIHQSITGLYETRIDLSQLGGDGGSGGSGGS
GGSGGSGGSGGMDKKYSIGLAIGTNSVGWAVITDEYKVPSKKFKVLGNTD
RHSIKKNLIGALLFDSGETAEATRLKRTARRRYTRRKNRICYLQEIFSNE
MAKVDDSFFHRLEESFLVEEDKKHERHPIFGNIVDEVAYHEKYPTIYHLR
KKLVDSTDKADLRLIYLALAHMIKFRGHFLIEGDLNPDNSDVDKLFIQLV
QTYNQLFEENPINASGVDAKAILSARLSKSRRLENLIAQLPGEKKNGLFG
NLIALSLGLTPNFKSNFDLAEDAKLQLSKDTYDDDLDNLLAQIGDQYADL

-continued
FLAAKNLSDAILLSDILRVNTEITKAPLSASMIKRYDEHHQDLTLLKALV
RQQLPEKYKEIFFDQSKNGYAGYIDGGASQEEFYKFIKPILEKMDGTEEL
LVKLNREDLLRKQRTFDNGSIPHQIHLGELHAILRRQEDFYPFLKDNREK
IEKILTFRIPYYVGPLARGNSRFAWMTRKSEETITPWNFEEVVDKGASAQ
SFIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFNA
SLGTYHDLLKIIKDKDFLDNEENEDILEDIVLTLTLFEDREMIEERLKTY
AHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQ
TVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVD
HIVPQSFLKDDSIDNKVLTRSDKNRGKSDNVPSEEVVKKMKNYWRQLLNA
KLITQRKFDNLTKAERGGLSELDKAGFIKRQLVETRQITKHVAQILDSRM
NTKYDENDKLIREVKVITLKSKLVSDFRKDFQFYKVREINNYHHAHDAYL
NAVVGTALIKKYPKLESEFVYGDYKVYDVRKMIAKSEQEGADKRTADGSE
FESPKKKRKV*

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN).

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that Cas12b/C2c1, CasX and CasY from other bacterial species may also be used in accordance with the present disclosure.

Cas12b/C2c1 (uniprot.org/uniprot/T0D7A2#2)
sp|T0D7A2|C2C1_ALIAG_CRISPR-associated endo- nuclease C2c1
OS = Alicyclobacillus acido-terrestris (strain ATCC 49025/DSM 3922/CIP 106132/NCIMB 13137/GD3B) GN = c2c1 PE = 1 SV = 1
(SEQ ID NO: 33)
MAVKSIKVKLRLDDMPEIRAGLWKLHKEVNAGVRYYTEWLSLLRQENLYRRSPNGDGEQECD
KTAEECKAELLERLRARQVENGHRGPAGSDDELLQLARQLYELLVPQAIGAKGDAQQIARKF
LSPLADKDAVGGLGIAKAGNKPRWVRMREAGEPGWEEEKEKAETRKSADRTADVLRALADFG
LKPLMRVYTDSEMSSVEWKPLRKGQAVRTWDRDMFQQAIERMMSWESWNQRVGQEYAKLVEQ
KNRFEQKNFVGQEHLVHLVNQLQQDMKEASPGLESKEQTAHYVTGRALRGSDKVFEKWGKLA

US 12,600,971 B2

67

68

-continued

PDAPFDLYDAEIKNVQRRNTRRFGSHDLFAKLAEPEYQALWREDASFLTRYAVYNSILRKLN

HAKMFATFTLPDATAHPIWTRFDKLGGNLHQYTFLFNEFGERRHAIRFHKLLKVENGVAREV

DDVTVPISMSEQLDNLLPRDPNEPIALYFRDYGAEQHFTGEFGGAKIQCRRDQLAHMHRRRG

ARDVYLNVSVRVQSQSEARGERRPPYAAVFRLVGDNHRAFVHFDKLSDYLAEHPDDGKLGSE

GLLSGLRVMSVDLGLRTSASISVFRVARKDELKPNSKGRVPFFFPIKGNDNLVAVHERSQLL

KLPGETESKDLRAIREERQRTLRQLRTQLAYLRLLVRCGSEDVGRRERSWAKLIEQPVDAAN

HMTPDWREAFENELQKLKSLHGICSDKEWMDAVYESVRRVWRHMGKQVRDWRKDVRSGERPK

IRGYAKDVVGGNSIEQIEYLERQYKFLKSWSFFGKVSGQVIRAEKGSRFAITLREHIDHAKE

DRLKKLADRIIMEALGYVYALDERGKGKWVAKYPPCQLILLEELSEYQFNNDRPPSENNQLM

QWSHRGVFQELINQAQVHDLLVGTMYAAFSSRFDARTGAPGIRCRRVPARCTQEHNPEPFPW

WLNKFVVEHTLDACPLRADDLIPTGEGEIFVSPFSAEEGDFHQIHADLNAAQNLQQRLWSDF

DISQIRLRCDWGEVDGELVLIPRLTGKRTADSYSNKVFYTNTGVTYYERERGKKRRKVFAQE

KLSEEEAELLVEADEAREKSVVLMRDPSGIINRGNWTRQKEFWSMV NQRIEGYLVKQIRSR

VPLQDSACENTGDI

CasX (uniprot.org/uniprot/F0NN87; uniprot.org/uniprot/F0NH53)
>tr|F0NN87|F0NN87_SULIH CRISPR-associated Casx protein OS =
*Sulfolobus islandicus* (strain HVE10/4) GN = SiH_0402 PE = 4
SV = 1
                                            (SEQ ID NO: 34)
MEVPLYNIFGDNYIIQVATEAENSTIYNNKVEIDDEELRNVLNLAYKIAKNNEDAAAERRGK

AKKKKGEEGETTTSNIILPLSGNDKNPWTETLKCYNFPTTVALSEVFKNFSQVKECEEVSAP

SFVKPEFYEFGRSPGMVERTRRVKLEVEPHYLIIAAAGWVLTRLGKAKVSEGDYVGVNVFTP

TRGILYSLIQNVNGIVPGIKPETAFGLWIARKVVSSVTNPNVSVVRIYTISDAVGQNPTTIN

GGFSIDLTKLLEKRYLLSERLEAIARNALSISSNMRERYIVLANYIYEYLTG SKRLEDLLY

FANRDLIMNLNSDDGKVRDLKLISAYVNGELIRGEG

>tr|F0NH53|F0NH53_SULIR CRISPR associated protein, Casx OS =
*Sulfolobus islandicus* (strain REY15A) GN = SiRe_0771 PE = 4
SV = 1
                                            (SEQ ID NO: 35)
MEVPLYNIFGDNYIIQVATEAENSTIYNNKVEIDDEELRNVLNLAYKIAKNNEDAAAERRGK

AKKKKGEEGETTTSNIILPLSGNDKNPWTETLKCYNFPTTVALSEVFKNFSQVKECEEVSAP

SFVKPEFYKFGRSPGMVERTRRVKLEVEPHYLIMAAAGWVLTRLGKAKVSEGDYVGVNVFTP

TRGILYSLIQNVNGIVPGIKPETAFGLWIARKVVSSVTNPNVSVVSIYTISDAVGQNPTTIN

GGFSIDLTKLLEKRDLLSERLEAIARNALSISSNMRERYIVLANYIYEYLTGSKRLEDLLYF

ANRDLIMNLNSDDGKVRDLKLISAYVNGELIRGEG

Deltaproteobacteria CasX
                                            (SEQ ID NO: 36)
MEKRINKIRKKLSADNATKPVSRSGPMKTLLVRVMTDDLKKRLEKRRKKPEVMPQVISNNAA

NNLRMLLDDYTKMKEAILQVYWQEFKDDHVGLMCKFAQPASKKIDQNKLKPEMDEKGNLTTA

GFACSQCGQPLFVYKLEQVSEKGKAYTNYFGRCNVAEHEKLILLAQLKPVKDSDEAVTYSLG

KFGQRALDFYSIHVTKESTHPVKPLAQIAGNRYASGPVGKALSDACMGTIASFLSKYQDIII

EHQKVVKGNQKRLESLRELAGKENLEYPSVTLPPQPHTKEGVDAYNEVIARVRMWVNLNLWQ

KLKLSRDDAKPLLRLKGFPSFPVVERRENEVDWWNTINEVKKLIDAKRDMGRVFWSGVTAEK

RNTILEGYNYLPNENDHKKREGSLENPKKPAKRQFGDLLLYLEKKYAGDWGKVFDEAWERID

KKIAGLTSHIEREEARNAEDAQSKAVLTDWLRAKASFVLERLKEMDEKEFYACEIQLQKWYG

DLRGNPFAVEAENRVVDISGFSIGSDGHSIQYRNLLAWKYLENGKREFYLLMNYGKKGRIRF

-continued

TDGTDIKKSGKWQGLLYGGGKAKVIDLTFDPDDEQLIILPLAFGTRQGREFIWNDLLSLETG

LIKLANGRVIEKTIYNKKIGRDEPALFVALTFERREVVDPSNIKPVNLIGVARGENIPAVIA

LTDPEGCPLPEFKDSSGGPTDILRIGEGYKEKQRAIQAAKEVEQRRAGGYSRKFASKSRNLA

DDMVRNSARDLFYHAVTHDAVLVFANLSRGFGRQGKRTFMTERQYTKMEDWLTAKLAYEGLT

SKTYLSKTLAQYTSKTCSNCGFTITYADMDVMLVRLKKTSDGWATTLNNKELKAEYQITYYN

RYKRQTVEKELSAELDRLSEESGNNDISKWTKGRRDEALFLLKKRFSHRPVQEQFVCLDCGH

EVHAAEQAALNIARSWLFLNSNSTEFKSYKSGKQPFVGAWQAFYKRRLKEVWKPNA

CasY (ncbi.nlm.nih.gov/protein/APG80656.1)
>APG80656.1 CRISPR-associated protein CasY [uncultured
Parcubacteria group bacterium]
                                              (SEQ ID NO: 37)
MSKRHPRISGVKGYRLHAQRLEYTGKSGAMRTIKYPLYSSPSGGRTVPREIVSAINDDYVGL

YGLSNFDDLYNAEKRNEEKVYSVLDFWYDCVQYGAVFSYTAPGLLKNVAEVRGGSYELTKTL

KGSHLYDELQIDKVIKFLNKKEISRANGSLDKLKKDIIDCFKAEYRERHKDQCNKLADDIKN

AKKDAGASLGERQKKLFRDFFGISEQSENDKPSFTNPLNLTCCLLPFDTVNNNRNRGEVLFN

KLKEYAQKLDKNEGSLEMWEYIGIGNSGTAFSNFLGEGFLGRLRENKITELKKAMMDITDAW

RGQEQEEELEKRLRILAALTIKLREPKFDNHWGGYRSDINGKLSSWLQNYINQTVKIKEDLK

GHKKDLKKAKEMINRFGESDTKEEAVVSSLLESIEKIVPDDSADDEKPDIPAIAIYRRFLSD

GRLTLNRFVQREDVQEALIKERLEAEKKKKPKKRKKKSDAEDEKETIDFKELFPHLAKPLKL

VPNFYGDSKRELYKKYKNAAIYTDALWKAVEKIYKSAFSSSLKNSFFDTDFDKDFFIKRLQK

IFSVYRRFNTDKWKPIVKNSFAPYCDIVSLAENEVLYKPKQSRSRKSAAIDKNRVRLPSTEN

IAKAGIALARELSVAGFDWKDLLKKEEHEEYIDLIELHKTALALLLAVTETQLDISALDFVE

NGTVKDFMKTRDGNLVLEGRFLEMFSQSIVFSELRGLAGLMSRKEFITRSAIQTMNGKQAEL

LYIPHEFQSAKITTPKEMSRAFLDLAPAEFATSLEPESLSEKSLLKLKQMRYYPHYFGYELT

RTGQGIDGGVAENALRLEKSPVKKREIKCKQYKTLGRGQNKIVLYVRSSYYQTQFLEWFLHR

PKNVQTDVAVSGSFLIDEKKVKTRWNYDALTVALEPVSGSERVFVSQPFTIFPEKSAEEEGQ

RYLGIDIGEYGIAYTALEITGDSAKILDQNFISDPQLKTLREEVKGLKLDQRRGTFAMPSTK

IARIRESLVHSLRNRIHHLALKHKAKIVYELEVSRFEEGKQKIKKVYATLKKADVYSEIDAD

KNLQTTVWGKLAVASEISASYTSQFCGACKKLWRAEMQVDETITTQELIGTVRVIKGGTLID

AIKDFMRPPIFDENDTPFPKYRDFCDKHHISKKMRGNSCLFICPFCRANADADIQASQTIAL

LRYVKEEKKVEDYFERFRKLKNIKVLGQMKKI

The term "Cas12" or "Cas12 domain" refers to an RNA guided nuclease comprising a Cas12 protein or a fragment thereof (e.g., a protein comprising an active, inactive, or partially active DNA cleavage domain of Cas12, and/or the gRNA binding domain of Cas12). Cas12 belongs to the class 2, Type V CRISPR/Cas system. A Cas12 nuclease is also referred to sometimes as a CRISPR (clustered regularly interspaced short palindromic repeat) associated nuclease. The sequence of an exemplary *Bacillus hisashii* Cas12b (BhCas12b) Cas12 domain is provided below:

(SEQ ID NO: 38)
MAPKKKRKVGIHGVPAAATRSFILKIEPNEEVKKGLWKTHEVLNHGIAYY

MNILKLIRQEAIYEHHEQDPKNPKKVSKAEIQAELWDFVLKMQKCNSFTH

EVDKDEVFNILRELYEELVPSSVEKKGEANQLSNKFLYPLVDPNSQSGKG

-continued

TASSGRKPRWYNLKIAGDPSWEEEKKKWEEDKKKDPLAKILGKLAEYGLI

PLFIPYTDSNEPIVKEIKWMEKSRNQSVRRLDKDMFIQALERFLSWESWN

LKVKEEYEKVEKEYKTLEERIKEDIQALKALEQYEKERQEQLLRDTLNTN

EYRLSKRGLRGWREIIQKWLKMDENEPSEKYLEVFKDYQRKHPREAGDYS

VYEFLSKKENHFIWRNHPEYPYLYATFCEIDKKKKDAKQQATFTLADPIN

HPLWVRFEERSGSNLNKYRILTEQLHTEKLKKKLTVQLDRLIYPTESGGW

EEKGKVDIVLLPSRQFYNQIFLDIEEKGKHAFTYKDESIKFPLKGTLGGA

RVQFDRDHLRRYPHKVESGNVGRIYFNMTVNIEPTESPVSKSLKIHRDDF

PKVVNFKPKELTEWIKDSKGKKLKSGIESLEIGLRVMSIDLGQRQAAAAS

-continued

IFEVVDQKPDIEGKLFFPIKGTELYAVHRASFNIKLPGETLVKSREVLRK

AREDNLKLMNQKLNFLRNVLHFQQFEDITEREKRVTKWISRQENSDVPLV

YQDELIQIRELMYKPYKDWVAFLKQLHKRLEVEIGKEVKHWRKSLSDGRK

GLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYN

PYEERSRFENSKLMKWSRREIPRQVALQGEIYGLQVGEVGAQFSSRFHAK

TGSPGIRCSVVTKEKLQDNRFFKNLQREGRLTLDKIAVLKEGDLYPDKGG

EKFISLSKDRKCVTTHADINAAQNLQKRFWTRTHGFYKVYCKAYQVDGQT

VYIPESKDQKQKIIEEFGEGYFILKDGVYEWVNAGKLKIKKGSSKQSSSE

LVDSDILKDSFDLASELKGEKLMLYRDPSGNVFPSDKWMAAGVFFGKLER

ILISKLTNQYSISTIEDDSSKQSMKRPAATKKAGQAKKKK.

Amino acid sequences having at least 85% or greater identity to the BhCas12b amino acid sequence are also useful in the methods of the invention.

By "Cbl proto-oncogene B (CBLB) polypeptide" is meant a protein having at least about 85% amino acid sequence identity to GenBank Accession No. ABC86700.1 or a fragment thereof that is involved in the regulation of immune responses. An exemplary CBLB polypeptide sequence is provided below.

>ABC86700.1 CBL-B [Homo sapiens]
(SEQ ID NO: 39)
MANSMNGRNPGGRGGNPRKGRILGIIDAIQDAVGPPKQAAADRRTVEKTW

KLMDKVVRLCQNPKLQLKNSPPYILDILPDTYQHLRLILSKYDDNQKLAQ

LSENEYFKIYIDSLMKKSKRAIRLFKEGKERMYEEQSQDRRNLTKLSLIF

SHMLAEIKAIFPNGQFQGDNFRITKADAAEFWRKFFGDKTIVPWKVFRQC

LHEVHQISSGLEAMALKSTIDLTCNDYISVFEFDIFTRLFQPWGSILRNW

NFLAVTHPGYMAFLTYDEVKARLQKYSTKPGSYIFRLSCTRLGQWAIGYV

TGDGNILQTIPHNKPLFQALIDGSREGFYLYPDGRSYNPDLTGLCEPTPH

DHIKVTQEQYELYCEMGSTFQLCKICAENDKDVKIEPCGHLMCTSCLTAW

QESDGQGCPFCRCEIKGTEPIIVDPFDPRDEGSRCCSIIDPFGMPMLDLD

DDDDREESLMMNRLANVRKCTDRQNSPVTSPGSSPLAQRRKPQPDPLQIP

HLSLPPVPPRLDLIQKGIVRSPCGSPTGSPKSSPCMVRKQDKPLPAPPPP

LRDPPPPPPERPPPIPPDNRLSRHIHHVESVPSRDPPMPLEAWCPRDVFG

TNQLVGCRLLGEGSPKPGITASSNVNGRHSRVGSDPVLMRKHRRHDLPLE

GAKVFSNGHLGSEEYDVPPRLSPPPPVTTLLPSIKCTGPLANSLSEKTRD

PVEEDDDEYKIPSSHPVSLNSQPSHCHNVKPPVRSCDNGHCMLNGTHGPS

SEKKSNIPDLSIYLKGDVFDSASDPVPLPPARPPTRDNPKHGSSLNRTPS

DYDLLIPPLGEDAFDALPPSLPPPPPPARHSLIEHSKPPGSSSRPSSGQD

LFLLPSDPFVDLASGQVPLPPARRLPGENVKTNRTSQDYDQLPSCSDGSQ

APARPPKPRPRRTAPEIHHRKPHGPEAALENVDAKIAKLMGEGYAFEEVK

RALEIAQNNVEVARSILREFAFPPPVSPRLNL

By "Cbl proto-oncogene B (CBLB) polynucleotide" is meant a nucleic acid molecule encoding a CBLB polypeptide. The CBLB gene encodes an E3 ubiquitin ligase. An exemplary CBLB nucleic acid sequence is provided below.

>DQ349203.1 Homo sapiens CBL-B mRNA, complete cds
(SEQ ID NO: 40)
ATGGCAAACTCAATGAATGGCAGAAACCCTGGTGGTCGAGGAGGAAATCC

CCGAAAAGGTCGAATTTTGGGTATTATTGATGCTATTCAGGATGCAGTTG

GACCCCCTAAGCAAGCTGCCGCAGATCGCAGGACCGTGGAGAAGACTTGG

AAGCTCATGGACAAAGTGGTAAGACTGTGCCAAAATCCCAAACTTCAGTT

GAAAAATAGCCCACCTATATATACTTGATATTTTGCCTGATACATATCAGC

ATTTACGACTTATATTGAGTAAATATGATGACAACCAGAAACTTGCCCAA

CTCAGTGAGAATGAGTACTTTAAAATCTACATTGATAGCCTTATGAAAAA

GTCAAAACGGGCAATAAGACTCTTTAAAGAAGGCAAGGAGAGAATGTATG

AAGAACAGTCACAGGACGACGAAATCTCACAAAACTGTCCCTTATCTTC

AGTCACATGCTGGCAGAAATCAAAGCAATCTTTCCCAATGGTCAATTCCA

GGGAGATAACTTTCGTATCACAAAAGCAGATGCTGCTGAATTCTGGAGAA

AGTTTTTTGGAGACAAAACTATCGTACCATGGAAAGTATTCAGACAGTGC

CTTCATGAGGTCCACCAGATTAGCTCTGGCCTGGAAGCAATGGCTCTAAA

ATCAACAATTGATTTAACTTGCAATGATTACATTTCAGTTTTTGAATTTG

ATATTTTTACCAGGCTGTTTCAGCCTTGGGGCTCTATTTTGCGGAATTGG

AATTTCTTAGCTGTGACACATCCAGGTTACATGGCATTTCTCACATATGA

TGAAGTTAAAGCACGACTACAGAAATATAGCACCAAACCCGGAAGCTATA

TTTTCCGGTTAAGTTGCACTCGATTGGGACAGTGGGCCATTGGCTATGTG

ACTGGGGATGGGAATATCTTACAGACCATACCTCATAACAAGCCCTTATT

TCAAGCCCTGATTGATGGCAGCAGGGAAGGATTTTATCTTTATCCTGATG

GGAGGAGTTATAATCCTGATTTAACTGGATTATGTGAACCTACACCTCAT

GACCATATAAAAGTTACACAGGAACAATATGAATTATATTGTGAAATGGG

CTCCACTTTTCAGCTCTGTAAGATTTGTGCAGAGAATGACAAAGATGTCA

AGATTGAGCCTTGTGGGCATTTGATGTGCACCTCTTGCCTTACGGCATGG

CAGGAGTCGGATGGTCAGGGCTGCCCTTTCTGTCGTTGTGAAATAAAAGG

AACTGAGCCCATAATCGTGGACCCCTTTGATCCAAGAGATGAAGGCTCCA

GGTGTTGCAGCATCATTGACCCCTTTGGCATGCCGATGCTAGACTTGGAC

GACGATGATGATCGTGAGGAGTCCTTGATGATGAATCGGTTGGCAAACGT

CCGAAAGTGCACTGACAGGCAGAACTCACCAGTCACATCACCAGGATCCT

CTCCCCTTGCCCAGAGAAGAAAGCCACAGCCTGACCCACTCCAGATCCCA

CATCTAAGCCTGCCACCCGTGCCTCCTCGCCTGGATCTAATTCAGAAAGG

CATAGTTAGATCTCCCTGTGGCAGCCCAACGGGTTCACCAAAGTCTTCTC

CTTGCATGGTGAGAAAACAAGATAAACCACTCCCAGCACCACCTCCTCCC

TTAAGAGATCCTCCTCCACCGCCACCTGAAAGACCTCCACCAATCCCACC

AGACAATAGACTGAGTAGACACATCCATCATGTGGAAAGCGTGCCTTCCA

GAGACCCGCCAATGCCTCTTGAAGCATGGTGCCCTCGGGATGTGTTTGGG

ACTAATCAGCTTGTGGGATGTCGACTCCTAGGGGAGGGCTCTCCAAAACC

TGGAATCACAGCGAGTTCAAATGTCAATGGAAGGCACAGTAGAGTGGGCT

CTGACCCAGTGCTTATGCGGAAACACAGACGCCATGATTTGCCTTTAGAA

GGAGCTAAGGTCTTTTCCAATGGTCACCTTGGAAGTGAAGAATATGATGT

US 12,600,971 B2

73
-continued

TCCTCCCCGGCTTTCTCCTCCTCCTCCAGTTACCACCCTCCTCCCTAGCA

TAAAGTGTACTGGTCCGTTAGCAAATTCTCTTTCAGAGAAAACAAGAGAC

CCAGTAGAGGAAGATGATGATGAATACAAGATTCCTTCATCCCACCCTGT

TTCCCTGAATTCACAACCATCTCATTGTCATAATGTAAAACCTCCTGTTC

GGTCTTGTGATAATGGTCACTGTATGCTGAATGGAACACATGGTCCATCT

TCAGAGAAGAAATCAAACATCCCTGACTTAAGCATATATTTAAAGGGAGA

TGTTTTTGATTCAGCCTCTGATCCCGTGCCATTACCACCTGCCAGGCCTC

CAACTCGGGACAATCCAAAGCATGGTTCTTCACTCAACAGGACGCCCTCT

GATTATGATCTTCTCATCCCTCCATTAGGTGAAGATGCTTTTGATGCCCT

CCCTCCATCTCTCCCACCTCCCCCACCTCCTGCAAGGCATAGTCTCATTG

AACATTCAAAACCTCCTGGCTCCAGTAGCCGGCCATCCTCAGGACAGGAT

CTTTTTCTTCTTCCTTCAGATCCCTTTGTTGATCTAGCAAGTGGCCAAGT

TCCTTTGCCTCCTGCTAGAAGGTTACCAGGTGAAAATGTCAAAACTAACA

GAACATCACAGGACTATGATCAGCTTCCTTCATGTTCAGATGGTTCACAG

GCACCAGCCAGACCCCCTAAACCACGACCGCGCAGGACTGCACCAGAAAT

TCACCACAGAAAACCCCATGGGCCTGAGGCGGCATTGGAAAATGTCGATG

CAAAAATTGCAAAACTCATGGGAGAGGGTTATGCCTTTGAAGAGGTGAAG

AGAGCCTTAGAGATAGCCCAGAATAATGTCGAAGTTGCCCGGAGCATCCT

CCGAGAATTTGCCTTCCCTCCTCCAGTATCCCCACGTCTAAATCTATAG

By "chimeric antigen receptor" or "CAR" is meant a synthetic receptor comprising an extracellular antigen binding domain, a transmembrane domain, and an intracellular signaling domain that confers specificity for an antigen onto an immune cell.

By "Class II Major Histocompatibility Complex Transactivator (CIITA) polypeptide" is meant a protein having at least about 85% amino acid sequence identity to NCBI Reference Sequence: NP_000237.2 or a fragment thereof that functions as a transcriptional coactivator. An exemplary CIITA polypeptide sequence is provided below.

(SEQ ID NO: 41)
1   mrclaprpag sylsepqgss qcatmelgpl eggylellns
    dadplclyhf ydqmdlagee 74
-continued 61   eielysepdt dtincdqfsr llcdmegdee treayaniae
     ldqyvfqdsq leglskdifk 121  higpdevige smempaevgq ksqkrpfpee lpadlkhwkp
     aeppvvtgs llvgpvsdcs 181  tlpclplpal fngepasgqm rlektdqipm pfsssslscl
     nlpegpiqfv ptistlphgl 241  wqiseagtgv ssifiyhgev pqasqvpppps gftvhglpts
     pdrpgstspf apsatdlpsm 301  pepaltsran mtehktsptq cpaagevsnk lpkwpepveq
     fyrslqdtyg aepagpdgil 361  vevdlvgarl erssssksler elatpdwaer glagggglaev
     llaakehrrp retrviavlg 421  kagqgksywa gaysrawacg rlpqydfvfs vpchclnrpg
     dayglqdllf slgpqplvaa 481  devfshilkr pdrvllildg feeleagdgf lhstcgpapa
     epcslrglla glfqkkllrg 541  ctlllltarpr grlvqslska dalfelsgfs megagayvmr
     yfessgmteh qdraltllrd 601  rplllshshs pticravcql seallelged aklpstltgl
     yvgllgraal dsppgalael 661  aklawelgrr hqstlqedqf psadvrtwam akglvqhppr
     aaeselafps fllqcflgal 721  wlalsgeikd kelpqylalt prkkrpydnw legvprflag
     lifqpparcl gallgpsaaa 781  svdrkqkvla rylkrlqpgt lrarqllell hcaheaeeag
     iwqhvvqelp grlsflgtrl 841  tppdahvlgk aleaagqdfs ldlrstgicp sglgslvgls
     cvtrfraals dtvalweslq 901  qhgetkllqa aeekftiepf kakslkdved lgklvqtqrt
     rsssedtage lpavrdlkkl 961  efalgpvsgp qafpklvril tafsslqhld ldalsenkig
     degvsqlsat fpglksletl 1021 nlsqnnitdl gayklaealp slaasllrls lynncicdvg
     aeslarvlpd mvslrvmdvq 1081 ynkftaagaq glaaslrrcp hvetlamwtp tipfsvqehl
     qqqdsrislr By "Class II Major Histocompatibility Complex Transactivator (CIITA) polynucleotide" is meant a nucleic acid molecule encoding a CIITA polypeptide. An exemplary CIITA nucleic acid sequence is provided below.

(SEQ ID NO: 42)
1 ggttagtgat gaggctagtg atgaggctgt gtgcttctga gctgggcatc cgaaggcatc 61 cttggggaag ctgagggcac gaggaggggc tgccagactc cgggagctgc tgcctggctg 121 ggattcctac acaatgcgtt gcctggctcc acgccctgct gggtcctacc tgtcagagcc 181 ccaaggcagc tcacagtgtg ccaccatgga gttggggccc ctagaaggtg gctacctgga 241 gcttcttaac agcgatgctg accccctgtg cctctaccac ttctatgacc agatggacct 301 ggctggagaa gaagagattg agctctactc agaacccgac acagacacca tcaactgcga 361 ccagttcagc aggctgttgt gtgacatgga aggtgatgaa gagaccaggg aggcttatgc 421 caatatcgcg gaactggacc agtatgtctt ccaggactcc cagctggagg gcctgagcaa 481 ggacattttc aagcacatag gaccagatga agtgatcggt gagagtatgg agatgccagc 541 agaagttggg cagaaaagtc agaaaagacc cttcccagag gagcttccgg cagacctgaa -continued

```
 601 gcactggaag ccagctgagc cccccactgt ggtgactggc agtctcctag tgggaccagt 661 gagcgactgc tccaccctgc cctgcctgcc actgcctgcg ctgttcaacc aggagccagc 721 ctccggccag atgcgcctgg agaaaaccga ccagattccc atgcctttct ccagttcctc 781 gttgagctgc ctgaatctcc ctgagggacc catccagttt gtccccacca tctccactct 841 gccccatggg ctctggcaaa tctctgaggc tggaacaggg gtctccagta tattcatcta 901 ccatggtgag gtgccccagg ccagccaagt accccctccc agtggattca ctgtccacgg 961 cctcccaaca tctccagacc ggccaggctc caccagcccc ttcgctccat cagccactga 1021 cctgcccagc atgcctgaac ctgccctgac ctcccgagca aacatgacag agcacaagac 1081 gtcccccacc caatgcccgg cagctggaga ggtctccaac aagcttccaa aatggcctga 1141 gccggtggag cagttctacc gctcactgca ggacacgtat ggtgccgagc ccgcaggccc 1201 ggatggcatc ctagtggagg tggatctggt gcaggccagg ctggagagga gcagcagcaa 1261 gagcctggag cgggaactgg ccaccccgga ctgggcagaa cggcagctgg cccaaggagg 1321 cctggctgag gtgctgttgg ctgccaagga gcaccggcgg ccgcgtgaga cacgagtgat 1381 tgctgtgctg ggcaaagctg gtcagggcaa gagctattgg gctgggggcag tgagccgggc 1441 ctgggcttgt ggccggcttc cccagtacga ctttgtcttc tctgtcccct gccattgctt 1501 gaaccgtccg ggggatgcct atggcctgca ggatctgctc ttctccctgg gcccacagcc 1561 actcgtggcg gccgatgagg ttttcagcca catcttgaag agacctgacc gcgttctgct 1621 catcctagac ggcttcgagg agctggaagc gcaagatggc ttcctgcaca gcacgtgcgg 1681 accggcaccg gcggagccct gctccctccg ggggctgctg gccggccttt tccagaagaa 1741 gctgctccga ggttgcaccc tcctcctcac agcccggccc cggggccgcc tggtccagag 1801 cctgagcaag gccgacgccc tatttgagct gtccggcttc tccatggagc aggcccaggc 1861 atacgtgatg cgctactttg agagctcagg gatgacagag caccaagaca gagccctgac 1921 gctcctccgg gaccggccac ttcttctcag tcacagccac agccctactt tgtgccgggc 1981 agtgtgccag ctctcagagg ccctgctgga gcttggggag gacgccaagc tgccctccac 2041 gctcacggga ctctatgtcg gcctgctggg ccgtgcagcc ctcgacagcc cccccgggga 2101 cctggcagag ctggccaagc tggcctggga gctgggccgc agacatcaaa gtaccctaca 2161 ggaggaccag ttcccatccg cagacgtgag gacctgggcg atggccaaag gcttagtcca 2221 acacccaccg cgggccgcag agtccgagct ggccttcccc agcttcctcc tgcaatgctt 2281 cctgggggcc ctgtggctgg ctctgagtgg cgaaatcaag gacaaggagc tcccgcagta 2341 cctagcattg accccaagga agaagaggcc ctatgacaac tggctggagg gcgtgccacg 2401 ctttctggct gggctgatct tccagcctcc cgcccgctgc ctgggagccc tactcgggcc 2461 atcggcggct gcctcggtgg acaggaagca gaaggtgctt gcgaggtacc tgaagcggct 2521 gcagccgggg acactgcggg cgcggcagct gctggagctg ctgcactgcg cccacgaggc 2581 cgaggaggct ggaatttggc agcacgtggt acaggagctc cccggccgcc tctcttttct 2641 gggcacccgc ctcacgcctc ctgatgcaca tgtactgggc aaggccttgg aggcggcggg 2701 ccaagacttc tccctggacc tccgcagcac tggcatttgc ccctctggat tggggagcct 2761 cgtgggactc agctgtgtca cccgtttcag ggctgccttg agcgacacgg tggcgctgtg 2821 ggagtccctg cagcagcatg gggagaccaa gctacttcag gcagcagagg agaagttcac 2881 catcgagcct ttcaaagcca agtccctgaa ggatgtggaa gacctgggaa agcttgtgca 2941 gactcagagg acgagaagtt cctcggaaga cacagctggg gagctccctg ctgttcggga
```

-continued

```
3001 cctaaagaaa ctggagtttg cgctgggccc tgtctcaggc ccccaggctt tccccaaact 3061 ggtgcggatc ctcacggcct tttcctccct gcagcatctg gacctggatg cgctgagtga 3121 gaacaagatc ggggacgagg gtgtctcgca gctctcagcc accttccccc agctgaagtc 3181 cttggaaacc ctcaatctgt cccagaacaa catcactgac ctgggtgcct acaaactcgc 3241 cgaggccctg ccttcgctcg ctgcatccct gctcaggcta agcttgtaca ataactgcat 3301 ctgcgacgtg ggagccgaga gcttggctcg tgtgcttccg gacatggtgt ccctccgggt 3361 gatggacgtc cagtacaaca agttcacggc tgccggggcc cagcagctcg ctgccagcct 3421 tcggaggtgt cctcatgtgg agacgctggc gatgtggacg cccaccatcc cattcagtgt 3481 ccaggaacac ctgcaacaac aggattcacg gatcagcctg agatgatccc agctgtgctc 3541 tggacaggca tgttctctga ggacactaac cacgctggac cttgaactgg gtacttgtgg 3601 acacagctct tctccaggct gtatcccatg agcctcagca tcctggcacc cggcccctgc 3661 tggttcaggg ttggcccctg cccggctgcg gaatgaacca catcttgctc tgctgacaga 3721 cacaggcccg gctccaggct cctttagcgc ccagttgggt ggatgcctgg tggcagctgc 3781 ggtccaccca ggagccccga ggccttctct gaaggacatt gcggacagcc acggccaggc 3841 cagagggagt gacagaggca gccccattct gcctgcccag gcccctgcca ccctggggag 3901 aaagtacttc ttttttttta tttttagaca gagtctcact gttgcccagg ctggcgtgca 3961 gtggtgcgat ctgggttcac tgcaacctcc gcctcttggg ttcaagcgat tcttctgctt 4021 cagcctcccg agtagctggg actacaggca cccaccatca tgtctggcta atttttcatt 4081 tttagtagag acagggtttt gccatgttgg ccaggctggt ctcaaactct tgacctcagg 4141 tgatccaccc acctcagcct cccaaagtgc tgggattaca agcgtgagcc actgcaccgg 4201 gccacagaga aagtacttct ccaccctgct ctccgaccag acaccttgac agggcacacc 4261 gggcactcag aagacactga tgggcaaccc ccagcctgct aattccccag attgcaacag 4321 gctgggcttc agtggcagct gcttttgtct atgggactca atgcactgac attgttggcc 4381 aaagccaaag ctaggcctgg ccagatgcac cagcccttag cagggaaaca gctaatggga 4441 cactaatggg gcggtgagag gggaacagac tggaagcaca gcttcatttc ctgtgtcttt 4501 tttcactaca ttataaatgt ctctttaatg tcacaggcag gtccagggtt tgagttcata 4561 ccctgttacc attttggggt acccactgct ctggttatct aatatgtaac aagccacccc 4621 aaatcatagt ggcttaaaac aacactcaca ttta
```

By "Cluster of Differentiation 7 (CD7) polypeptide" is meant a protein having at least about 85% amino acid sequence identity to NCBI Reference Sequence: NP_006128.1 or a fragment thereof that is involved in T-cell and T-cell/B-cell interactions. An exemplary CD7 polypeptide sequence is provided below.

```
                                    (SEQ ID NO: 43)
  1 magpprllll plllalargl pgalaaqevq qsphcttvpv
    gasvnitcst sgglrgiylr 61 qlgpqpqdii yyedgvvptt drrfrgridf sgsqdnitit
    mhrlqlsdtg tytcqaitev 121 nvygsgtivl vteeqsqgwh rcsdappras alpapptgsa
    lpdpqtasal pdppaasalp 181 aalavisfll glglgvacvl artqikklcs wrdknsaacv
    vyedmshsrc ntlsspnqyq
```

By "Cluster of Differentiation 7 (CD7) polynucleotide" is meant a nucleic acid molecule encoding a CD7 polypeptide.

The CD7 gene encodes a transmembrane protein. An exemplary CD7 nucleic acid sequence is provided below.

```
                                    (SEQ ID NO: 44)
  1 ctctctgagc tctgagcgcc tgcggtctcc tgtgtgctgc
    tctctgtggg gtcctgtaga 61 cccagagagg ctcagctgca ctcgcccggc tgggagagct
    gggtgtgggg aacatggccg 121 ggcctccgag gctcctgctg ctgcccctgc ttctggcgct
    ggctcgcggc ctgcctgggg 181 ccctggctgc ccaagaggtg cagcagtctc cccactgcac
    gactgtcccc gtgggagcct 241 ccgtcaacat cacctgctcc accagcgggg gcctgcgtgg
    gatctacctg aggcagctcg 301 ggccacagcc ccaagacatc atttactacg aggacggggt
    ggtgcccact acggacagac
```

-continued

```
361 ggttccgggg ccgcatcgac ttctcagggt cccaggacaa
    cctgactatc accatgcacc 421 gcctgcagct gtcggacact ggcacctaca cctgccaggc
    catcacggag gtcaatgtct 481 acggctccgg caccctggtc ctggtgacag aggaacagtc
    ccaaggatgg cacagatgct 541 cggacgcccc accaagggcc tctgccctcc ctgccccacc
    gacaggctcc gccctccctg 601 acccgcagac agcctctgcc ctccctgacc cgccagcagc
    ctctgccctc cctgcggccc 661 tggcggtgat ctccttcctc ctcgggctgg gcctgggggt
    ggcgtgtgtg ctggcgagga 721 cacagataaa gaaactgtgc tcgtggcggg ataagaattc
    ggcggcatgt gtggtgtacg 781 aggacatgtc gcacagccgc tgcaacacgc tgtcctcccc
    caaccagtac cagtgaccca 841 gtgggcccct gcacgtcccg cctgtggtcc ccccagcacc
    ttccctgccc caccatgccc 901 cccaccctgc cacacccctc accctgctgt cctcccacgg
    ctgcagcaga gtttgaaggg 961 cccagccgtg cccagctcca agcagacaca caggcagtgg
    ccaggcccca cggtgcttct 1021 cagtggacaa tgatgcctcc tccgggaagc cttccctgcc
     cagcccacgc cgccaccggg 1081 aggaagcctg actgtccttt ggctgcatct cccgaccatg
     gccaaggagg gcttttctgt 1141 gggatgggcc tgggcacgcg gccctctcct gtcagtgccg
     gcccacccac cagcaggccc
```

-continued

```
1201 ccaaccccca ggcagcccgg cagaggacgg gaggagacca
     gtcccccacc cagccgtacc 1261 agaaataaag gcttctgtgc ttcc
```

By "Cluster of Differentiation 5 (CD5) polypeptide" is meant a protein having at least about 85% amino acid sequence identity to NCBI Reference Sequence: NP_001333385.1 or a fragment thereof that is expressed on the surface of a T-cell. An exemplary CD5 polypeptide sequence is provided below.

```
                                       (SEQ ID NO: 45)
  1 mvcsqswgrs skqwedpsqa skvcqrincg vplslgpflv
    tytpcissiic ygglgsfsnc 61 shsrndmchs lgltclepqk ttppttrppp tttpeptapp
    rlqlvaqsgg qhcagvvefy 121 sgslggtisy eaqdktqdle nflcnnlqcg sflkhlpete
    agraqdpgep rehulpiqw 181 kiqnssctsl ehcfrkikpq ksgrvlallc sgfqpkvqsr
    lvggssiceg tvevrqgaqw 241 aalcdsssar sslrweevcr eqqcgsvnsy rvldagdpts
    rglfcphqkl sqchelwern 301 syckkvfvtc qdpnpaglaa gtvasiilal vllvvllvvc
    gplaykklvk kfrqkkqrqw 361 igptgmnqnm sfhrnhtatv rshaenptas hvdneysqpp
    rnshlsaypa legalhrssm 421 qpdnssdsdy dlhgagrl
```

By "Cluster of Differentiation 5 (CD5) polynucleotide" is meant a nucleic acid molecule encoding a CD5 polypeptide. The CD5 gene encodes a transmembrane protein. An exemplary CD5 nucleic acid sequence is provided below.

```
                                       (SEQ ID NO: 46)
   1 gagtcttgct gatgctcccg gctgaataaa ccccttcctt ctttaacttg gtgtctgagg 61 ggttttgtct gtggcttgtc ctgctacatt tcttggttcc ctgaccagga agcaaagtga 121 ttaacggaca gttgaggcag ccccttaggc agcttaggcc tgccttgtgg agcatccccg 181 cggggaactc tggccagctt gagcgacacg gatcctcaga gcgctcccag gtaggcaatt 241 gccccagtgg aatgcctcgt cagagcagtg catggcaggc ccctgtggag gatcaacgca 301 gtggctgaac acagggaagg aactggcact tggagtccgg acaactgaaa cttgtcgctt 361 cctgcctcgg acggctcagc tggtatgacc cagatttcca ggcaaggctc acccgttcca 421 actcgaagtg ccaggccag ctggaggtct acctcaagga cggatggcac atggtttgca 481 gccagagctg gggccggagc tccaagcagt gggaggaccc cagtcaagcg tcaaaagtct 541 gccagcggct gaactgtggg gtgcccttaa gccttggccc cttccttgtc acctacacac 601 ctcagagctc aatcatctgc tacggacaac tgggctcctt ctccaactgc agccacagca 661 gaaatgacat gtgtcactct ctgggcctga cctgcttaga accccagaag acaacacctc 721 caacgacaag gcccccgccc accacaactc cagagcccac agctcctccc aggctgcagc 781 tggtggcaca gtctggcggc cagcactgtg ccggcgtggt ggagttctac agcggcagcc 841 tggggggtac catcagctat gaggcccagg acaagaccca ggacctggag aacttcctct 901 gcaacaacct ccagtgtggc tccttcttga agcatctgcc agagactgag gcaggcagag 961 cccaagaccc aggggagcca cgggaacacc agcccttgcc aatccaatgg aagatccaga 1021 actcaagctg tacctccctg gagcattgct tcaggaaaat caagccccag aaaagtggcc
```

-continued

```
1081 gagttcttgc cctcctttgc tcaggtttcc agcccaaggt gcagagccgt ctggtggggg 1141 gcagcagcat ctgtgaaggc accgtggagg tgcgccaggg ggctcagtgg gcagccctgt 1201 gtgacagctc ttcagccagg agctcgctgc ggtgggagga ggtgtgccgg gagcagcagt 1261 gtggcagcgt caactcctat cgagtgctgg acgctggtga cccaacatcc cggggggctct 1321 tctgtcccca tcagaagctg tcccagtgcc acgaactttg ggagagaaat tcctactgca 1381 agaaggtgtt tgtcacatgc caggatccaa accccgcagg cctggccgca ggcacggtgg 1441 caagcatcat cctggccctg gtgctcctgg tggtgctgct ggtcgtgtgc ggcccccttg 1501 cctacaagaa gctagtgaag aaattccgcc agaagaagca gcgccagtgg attggcccaa 1561 cgggaatgaa ccaaaacatg tctttccatc gcaaccacac ggcaaccgtc cgatcccatg 1621 ctgagaaccc cacagcctcc cacgtggata acgaatacag ccaacctccc aggaactccc 1681 acctgtcagc ttatccagct ctggaagggg ctctgcatcg ctcctccatg cagcctgaca 1741 actcctccga cagtgactat gatctgcatg gggctcagag gctgtaaaga actgggatcc 1801 atgagcaaaa agccgagagc cagacctgtt tgtcctgaga aaactgtccg ctcttcactt 1861 gaaatcatgt ccctatttct accccggcca gaacatggac agaggccaga agccttccgg 1921 acaggcgctg ctgccccgag tggcaggcca gctcacactc tgctgcacaa cagctcggcc 1981 gcccctccac ttgtggaagc tgtggtgggc agagccccaa aacaagcagc cttccaacta 2041 gagactcggg ggtgtctgaa gggggccccc tttccctgcc cgctggggag cggcgtctca 2101 gtgaaatcgg ctttctcctc agactctgtc cctggtaagg agtgacaagg aagctcacag 2161 ctgggcgagt gcattttgaa tagttttttg taagtagtgc ttttcctcct tcctgacaaa 2221 tcgagcgctt tggcctcttc tgtgcagcat ccacccctgc ggatccctct ggggaggaca 2281 ggaaggggac tcccggagac ctctgcagcc gtggtggtca gaggctgctc acctgagcac 2341 aaagacagct ctgcacattc accgcagctg ccagccaggg gtctgggtgg gcaccaccct 2401 gacccacagc gtcaccccac tccctctgtc ttatgactcc cctccccaac cccctcatct 2461 aaagacacct tcctttccac tggctgtcaa gcccacaggg caccagtgcc acccagggcc 2521 cggcacaaag gggcgcctag taaaccttaa ccaacttggt tttttgcttc acccagcaat 2581 taaaagtccc aagctgaggt agtttcagtc catcacagtt catcttctaa cccaagagtc 2641 agagatgggg ctggtcatgt tcctttggtt tgaataactc ccttgacgaa aacagactcc 2701 tctagtactt ggagatcttg acgtacacc taatcccatg gggcctcggc ttccttaact 2761 gcaagtgaga agaggaggtc tacccaggag cctcgggtct gatcaaggga gaggccaggc 2821 gcagctcact gcggcggctc cctaagaagg tgaagcaaca tgggaacaca tcctaagaca 2881 ggtcctttct ccacgccatt tgatgctgta tctcctggga gcacaggcat caatggtcca 2941 agccgcataa taagtctgga agagcaaaag ggagttacta ggatatgggg tgggctgctc 3001 ccagaatctg ctcagctttc tgcccccacc aacaccctcc aaccaggcct tgccttctga 3061 gagcccccgt ggccaagccc aggtcacaga tcttcccccg accatgctgg gaatccagaa 3121 acagggaccc catttgtctt cccatatctg gtggaggtga gggggctcct caaaagggaa 3181 ctgagaggct gctcttaggg agggcaaagg ttcggggca gccagtgtct cccatcagtg 3241 ccttttttaa taaaagctct ttcatctata gtttggccac catacagtgg cctcaaagca 3301 accatggcct acttaaaaac caaaccaaaa ataaagagtt tagttgagga gaaaaaaaaa 3361 aaaaaaaaaa aaaaa
```

65

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained; serine for threonine such that a free —OH can be maintained; and glutamine for asparagine such that a free —NH$_2$ can be maintained.

The term "coding sequence" or "protein coding sequence" as used interchangeably herein refers to a segment of a polynucleotide that codes for a protein. The region or sequence is bounded nearer the 5' end by a start codon and nearer the 3' end with a stop codon. Coding sequences can also be referred to as open reading frames.

By "cytotoxic T-lymphocyte associated protein 4 (CTLA-4) polypeptide" is meant a protein having at least about 85% sequence identity to NCBI Accession No. EAW70354.1 or a fragment thereof. An exemplary amino acid sequence is provided below:

```
>EAW70354.1 cytotoxic T-lymphocyte-associated
protein 4 [Homo sapiens]
                                    (SEQ ID NO: 47)
MACLGFQRHKAQLNLATRTWPCTLLFFLLFIPVFCKAMHVAQPAVVLASS

RGIASFVCEYASPGKATEVRVTVLRQADSQVTEVCAATYMMGNELTFLDD

SICTGTSSGNQVNLTIQGLRAMDTGLYICKVELMYPPPYYLGIGNGTQIY

VIDPEPCPDSDFLLWILAAVSSGLFFYSFLLTAVSLSKMLKKRSPLTTGV

YVKMPPTEPECEKQFQPYFIPIN
```

By "cytotoxic T-lymphocyte associated protein 4 (CTLA-4) polynucleotide" is meant a nucleic acid molecule encoding a CTLA-4 polypeptide. The CTLA-4 gene encodes an immunoglobulin superfamily and encodes a protein which transmits an inhibitory signal to T cells. An exemplary CTLA-4 nucleic acid sequence is provided below.

```
>BC074842.2 Homo sapiens cytotoxic
T-lymphocyte-associated protein 4, mRNA (cDNA
clone MGC:104099 IMAGE: 30915552), complete cds
                                    (SEQ ID NO: 48)
GACCTGAACACCGCTCCCATAAAGCCATGGCTTGCCTTGGATTTCAGCGG

CACAAGGCTCAGCTGAACCTGGCTACCAGGACCTGGCCCTGCACTCTCCT

GTTTTTTCTTCTCTTCATCCCTGTCTTCTGCAAAGCAATGCACGTGGCCC

AGCCTGCTGTGGTACTGGCCAGCAGCCGAGGCATCGCCAGCTTTGTGTGT

GAGTATGCATCTCCAGGCAAAGCCACTGAGGTCCGGGTGACAGTGCTTCG

GCAGGCTGACAGCCAGGTGACTGAAGTCTGTGCGGCAACCTACATGATGG

GGAATGAGTTGACCTTCCTAGATGATTCCATCTGCACGGGCACCTCCAGT

GGAAATCAAGTGAACCTCACTATCCAAGGACTGAGGGCCATGGACACGGG

ACTCTACATCTGCAAGGTGGAGCTCATGTACCCACCGCCATACTACCTGG

GCATAGGCAACGGAACCCAGATTTATGTAATTGATCCAGAACCGTGCCCA
```

-continued

```
GATTCTGACTTCCTCCTCTGGATCCTTGCAGCAGTTAGTTCGGGGTTGTT

TTTTTATAGCTTTCTCCTCACAGCTGTTTCTTTGAGCAAAATGCTAAAGA

AAAGAAGCCCTCTTACAACAGGGGTCTATGTGAAAATGCCCCCAACAGAG

CCAGAATGTGAAAAGCAATTTCAGCCTTATTTTATTCCCATCAATTGAGA

AACCATTATGAAGAAGAGAGTCCATATTTCAATTTCCAAGAGCTGAGG
```

The term "deaminase" or "deaminase domain," as used herein, refers to a protein or enzyme that catalyzes a deamination reaction. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The adenosine deaminases (e.g., engineered adenosine deaminases, evolved adenosine deaminases) provided herein can be from any organism, such as a bacterium. In some embodiments, the adenosine deaminase is from a bacterium, such as Escherichia coli, Staphylococcus aureus, Salmonella typhimurium, Shewanella putrefaciens, Haemophilus influenzae, or Caulobacter crescentus.

In some embodiments, the adenosine deaminase is a TadA deaminase. In some embodiments, the TadA deaminase is TadA variant. In some embodiments, the TadA variant is a TadA*8. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also, see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immuno-chemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. In one embodiment, the disease is a neoplasia or cancer.

The term "effective amount," as used herein, refers to an amount of a biologically active agent that is sufficient to elicit a desired biological response. The effective amount of an active agent(s) used to practice the present invention for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In one embodiment, an effective amount is the amount of a base editor of the invention (e.g., a fusion protein comprising a programable DNA binding protein, a nucleobase editor and gRNA) sufficient to introduce an alteration in a gene of interest in a cell (e.g., a cell in vitro or in vivo). In one embodiment, an effective amount is the amount of a base editor required to achieve a therapeutic effect (e.g., to reduce or control a disease or a symptom or condition thereof). Such therapeutic effect need not be sufficient to alter a gene of interest in all cells of a subject, tissue or organ, but only to alter a gene of interest in about 1%, 5%, 10%, 25%, 50%, 75% or more of the cells present in a subject, tissue or organ.

"Epitope," as used herein, means an antigenic determi-nant. An epitope is the part of an antigen molecule that by its structure determines the specific antibody molecule that will recognize and bind it.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Graft-versus-host disease" (GVHD) refers to a patho-logical condition where transplanted cells of a donor gen-erate an immune response against cells of the host.

By "guide RNA" or "gRNA" is meant a polynucleotide which can be specific for a target sequence and can form a complex with a polynucleotide programmable nucleotide binding domain protein (e.g., Cas9 or Cpf1). In an embodi-ment, the guide polynucleotide is a guide RNA (gRNA). gRNAs can exist as a complex of two or more RNAs, or as a single RNA molecule. gRNAs that exist as a single RNA molecule may be referred to as single-guide RNAs (sgR-NAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821 (2012), the entire contents of which is incorporated herein by reference. Other examples of gRNAs (e.g., those includ-ing domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." An extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. As will be appreciated by those skilled in the art, RNA polynucleotide sequences, e.g., gRNA sequences, include the nucleobase uracil (U), a pyrimidine derivative, rather than the nucleobase thymine (T), which is included in DNA polynucleotide sequences. In RNA, uracil base-pairs with adenine and replaces thymine during DNA transcrip-tion.

By "heterodimer" is meant a fusion protein comprising two domains, such as a wild type TadA domain and a variant of TadA domain (e.g., TadA*8) or two variant TadA domains (e.g., TadA*7.10 and TadA*8 or two TadA*8 domains).

"Host-versus-graft disease" (HVGD) refers to a patho-logical condition where the immune system of a host gen-erates an immune response against transplanted cells of a donor.

"Hybridization" means hydrogen bonding, which may be Watson-Crick, Hoogsteen or reversed Hoogsteen hydrogen bonding, between complementary nucleobases. For example, adenine and thymine are complementary nucle-obases that pair through the formation of hydrogen bonds.

By "immune cell" is meant a cell of the immune system capable of generating an immune response.

By "immune effector cell" is meant a lymphocyte, once activated, capable of effecting an immune response upon a target cell. A T cell is an exemplary immune effector cell.

The term "inhibitor of base repair" or "IBR" refers to a protein that is capable in inhibiting the activity of a nucleic acid repair enzyme, for example a base excision repair (BER) enzyme. In some embodiments, the IBR is an inhibi-tor of inosine base excision repair. Exemplary inhibitors of base repair include inhibitors of APE1, Endo III, Endo IV, Endo V, Endo VIII, Fpg, hOGG1, hNEIL1, T7 Endol, T4PDG, UDG, hSMUG1, and hAAG.

In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG.

In some embodiments, the base repair inhibitor is uracil glycosylase inhibitor (UGI). UGI refers to a protein that is capable of inhibiting a uracil-DNA glycosylase base-exci-sion repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease. Without wishing to be bound by any particular theory, catalytically inactive inosine glycosylases (e.g., alkyl adenine glycosylase (AAG)) can bind inosine, but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation or a corresponding mutation in another AAG nuclease.

By "increases" is meant a positive alteration of at least 10%, 25%, 50%, 75%, or 100%.

An "intein" is a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Other intein systems may also be used. For example, a synthetic intein based on the dnaE intein, the Cfa-N (e.g., split intein-N) and Cfa-C (e.g., split intein-C) intein pair, has been described (e.g., in Stevens et al., J Am Chem Soc. 2016 Feb. 24; 138(7):2162-5, incorporated herein by reference). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference).

Exemplary nucleotide and amino acid sequences of inteins are provided.

DnaE Intein-N DNA:

(SEQ ID NO: 49)
TGCCTGTCATACGAAACCGAGATACTGACAGTAGAATATGGCCTTCTGCC

AATCGGGAAGATTGTGGAGAAACGGATAGAATGCACAGTTTACTCTGTCG

ATAACAATGGTAACATTTATACTCAGCCAGTTGCCCAGTGGCACGACCGG

GGAGAGCAGGAAGTATTCGAATACTGTCTGGAGGATGGAAGTCTCATTAG

GGCCACTAAGGACCACAAATTTATGACAGTCGATGGCCAGATGCTGCCTA

TAGACGAAATCTTTGAGCGAGAGTTGGACCTCATGCGAGTTGACAACCTT

CCTAT

-continued

DnaE Intein-N Protein:

(SEQ ID NO: 50)
CLSYETEILTVEYGLLPIGKIVEKRIECTVYSVDNNGNIYTQPVAQWHDR

GEQEVFEYCLEDGSLIRATKDHKFMTVDGQMLPIDEIFERELDLMRVDNL

PN

DnaE Intein-C DNA:

(SEQ ID NO: 51)
ATGATCAAGATAGCTACAAGGAAGTATCTTGGCAAACAAAACGTTTATGA

TATTGGAGTCGAAAGAGATCACAACTTTGCTCTGAAGAACGGATTCATAG

CTTCTAT (SEQ ID NO: 52)
Intein-C: MIKIATRKYLGKQNVYDIGVERDHNFALKNGFIASN

Cfa-N DNA:

(SEQ ID NO: 53)
TGCCTGTCTTATGATACCGAGATACTTACCGTTGAATATGGCTTCTTGCC

TATTGGAAAGATTGTCGAAGAGAGAATTGAATGCACAGTATATACTGTAG

ACAAGAATGGTTTCGTTTACACACAGCCCATTGCTCAATGGCACAATCGC

GGCGAACAAGAAGTATTTGAGTACTGTCTCGAGGATGGAAGCATCATACG

AGCAACTAAAGATCATAAATTCATGACCACTGACGGGCAGATGTTGCCAA

TAGATGAGATATTCGAGCGGGGCTTGGATCTCAAACAAGTGGATGGATTG

CCA

Cfa-N Protein:

(SEQ ID NO: 54)
CLSYDTEILTVEYGFLPIGKIVEERIECTVYTVDKNGFVYTQPIAQWHNR

GEQEVFEYCLEDGSIIRATKDHKFMTTDGQMLPIDEIFERGLDLKQVDGL

P

Cfa-C DNA:

(SEQ ID NO: 55)
ATGAAGAGGACTGCCGATGGATCAGAGTTTGAATCTCCCAAGAAGAAGAG

GAAAGTAAAGATAATATCTCGAAAAAGTCTTGGTACCCAAAATGTCTATG

ATATTGGAGTGGAGAAAGATCACAACTTCCTTCTCAAGAACGGTCTCGTA

GCCAGCAAC

Cfa-C Protein:

(SEQ ID NO: 56)
MKRTADGSEFESPKKKRKVKIISRKSLGTQNVYDIGVEKDHNFLLKNGLV

ASN

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N--[N-terminal portion of the split Cas9]-[intein-N]--C. In some embodiments, an intein-C is fused to the N-terminus of the C-terminal portion of the split Cas9, i.e., to form a structure of N-[intein-C]--[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5(1):446-461, incorporated herein by reference. Methods for designing and using inteins are known in the art and described, for example by WO2014004336, WO2017132580, US20150344549, and US20180127780, each of which is incorporated herein by reference in their entirety.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker", as used herein, can refer to a covalent linker (e.g., covalent bond), a non-covalent linker, a chemical group, or a molecule linking two molecules or moieties, e.g., two components of a protein complex or a ribonucleo-complex, or two domains of a fusion protein, such as, for example, a polynucleotide programmable DNA binding domain (e.g., dCas9) and a deaminase domain ((e.g., an adenosine deaminase, a cytidine deaminase, or an adenosine deaminase and a cytidine deaminase). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join an RNA-binding portion of a deaminating component and a polynucleotide programmable nucleotide binding component of a base editor system. In some embodiments, a linker can join an RNA-binding portion of a deaminating component and an RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be an RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a prequeosine1 (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or an RNA recognition motif. In some embodiments, the polypeptide ligand may be a portion of a base editor system component. For example, a nucleobase editing component may comprise a deaminase domain and an RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., cytidine or adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated.

In some embodiments, the domains of the nucleobase editor are fused via a linker that comprises the amino acid sequence of SGGSSGSETPGTSESATPESSGGS (SEQ ID NO: 57), SGGSSGGSSGSETPGTSESATPESSGGSSGGS (SEQ ID NO: 58), or GGSGGSPGSPAGSPTSTEEGTS-ESATPESGPGTSTEPSEGSAPGSPAGSPTSTEEGTSTE PSEGSAPGTSTEPSEGSAPGTSESATPESGPGSEP-ATSGGSGGS (SEQ ID NO: 59). In some embodiments, domains of the nucleobase editor are fused via a linker comprising the amino acid sequence SGSETPGTSESAT-PES (SEQ ID NO: 60), which may also be referred to as the XTEN linker. In some embodiments, a linker comprises the amino acid sequence SGGS (SEQ ID NO: 61). In some embodiments, a linker comprises (SGGS)$_n$ (SEQ ID NO: 62), (GGGS)$_n$ (SEQ ID NO: 63), (GGGGS)$_n$ (SEQ ID NO: 64), (G). (SEQ ID NO: 65), (EAAAK)$_n$ (SEQ ID NO: 66), (GGS)$_n$ (SEQ ID NO: 67), SGSETPGTSESATPES (SEQ ID NO: 60), or (XP)$_n$ motif (SEQ ID NO: 68), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the linker is 24 amino acids in length. In some embodiments, the linker comprises the amino acid sequence SGGSSGGSSGSETPGTSESATPES (SEQ ID NO: 6). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 69). In some embodiments, the linker is 64 amino acids in length. In some embodiments, the linker comprises the amino acid sequence SGGSSGGSSGSETPGTSESAT-PESSGGSSGGSSGGSSGGSSGGSSGSETPGTSESAT-PESSGGS SGGS (SEQ ID NO: 70). In some embodiments, the linker is 92 amino acids in length. In some embodiments, the linker comprises the amino acid sequence

```
                                    (SEQ ID NO: 71)
PGSPAGSPTSTEEGTSESATPESGPGTSTEPSEGSAPGSPAGSPTSTEEG

TSTEPSEGSAPGTSTEPSEGSAPGTSESATPESGPGSEPATS.
```

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). In some embodiments, the presently disclosed base editors can efficiently generate an "intended mutation," such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., cytidine base editor or adenosine base editor) bound to a guide polynucleotide (e.g., gRNA), specifically designed to generate the intended mutation.

In general, mutations made or identified in a sequence (e.g., an amino acid sequence as described herein) are numbered in relation to a reference (or wild-type) sequence, i.e., a sequence that does not contain the mutations. The skilled practitioner in the art would readily understand how to determine the position of mutations in amino acid and nucleic acid sequences relative to a reference sequence.

"Neoplasia" refers to cells or tissues exhibiting abnormal growth or proliferation. The term neoplasia encompasses cancer and solid tumors.

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

By "nuclear factor of activated T cells 1 (NFATc1) polypeptide" is meant a protein having at least about 85% amino acid sequence identity to NCBI Accession No. NM_172390.2 or a fragment thereof and is a component of the activated T cell DNA-binding transcription complex. An exemplary amino acid sequence is provided below.

```
>NP_765978.1 nuclear factor of activated T-cells,
cytoplasmic 1 isoform A [Homo sapiens]
                                    (SEQ ID NO: 72)
MPSTSFPVPSKFPLGPAAAVFGRGETLGPAPRAGGTMKSAEEEHYGYASS

NVSPALPLPTAHSTLPAPCHNLQTSTPGIIPPADHPSGYGAALDGGPAGY

FLSSGHTRPDGAPALESPRIEITSCLGLYHNNNQFFHDVEVEDVLPSSKR

SPSTATLSLPSLEAYRDPSCLSPASSLSSRSCNSEASSYESNYSYPYASP

QTSPWQSPCVSPKTTDPEEGFPRGLGACTLLGSPRHSPSTSPRASVTEES

WLGARSSRPASPCNKRKYSLNGRQPPYSPHHSPTPSPHGSPRVSVTDDSW

LGNTTQYTSSAIVAAINALTTDSSLDLGDGVPVKSRKTTLEQPPSVALKV

EPVGEDLGSPPPPADFAPEDYSSFQHIRKGGFCDQYLAVPQHPYQWAKPK

PLSPTSYMSPTLPALDWQLPSHSGPYELRIEVQPKSHHRAHYETEGSRGA

VKASAGGHPIVQLHGYLENEPLMLQLFIGTADDRLLRPHAFYQVHRITGK

TVSTTSHEAILSNTKVLEIPLLPENSMRAVIDCAGILKLRNSDIELRKGE

TDIGRKNTRVRLVFRVHVPQPSGRTLSLQVASNPIECSQRSAQELPLVEK

QSTDSYPVVGGKKMVLSGHNFLQDSKVIFVEKAPDGHHVWEMEAKTDRDL

CKPNSLVVEIPPFRNQRITSPVHVSFYVCNGKRKRSQYQRFTYLPANGNA

IFLTVSREHERVGCFF
```

By "nuclear factor of activated T cells 1 (NFATc1) polynucleotide" is meant a nucleic acid molecule encoding a NFATc1 polypeptide. The NFATc1 gene encodes a protein that is involved in in the inducible expression of cytokine genes, especially IL-2 and IL-4, in T-cells. An exemplary nucleic acid sequenced is provided below.

```
>NM_172390.2 Homo sapiens nuclear factor of
activated T cells 1 (NFATC1), transcript
variant 1, mRNA
                                    (SEQ ID NO: 73)
GGCGGGCGCTCGGCGACTCGTCCCCGGGGCCCCGCGCGGGCCCGGGCAGC

AGGGGCGTGATGTCACGGCAGGGAGGGGGCGCGGGAGCCGCCGGGCCGGC

GGGGAGGCGGGGGAGGTGTTTTCCAGCTTTAAAAAGGCAGGAGGCAGAGC

GCGGCCCTGCGTCAGAGCGAGACTCAGAGGCTCCGAACTCGCCGGCGGAG

TCGCCGCGCCAGATCCCAGCAGCAGGGCGCGGGCACCGGGGCGCGGGCAG

GGCTCGGAGCCACCGCGCAGGTCCTAGGGCCGCGGCCGGGCCCCGCCACG

CGCGCACACGCCCCTCGATGACTTTCCTCCGGGGCGCGCGGCGCTGAGCC

CGGGGCGAGGGCTGTCTTCCCGGAGACCCGACCCCGGCAGCGCGGGGCGG

CCGCTTCTCCTGTGCCTCCGCCCGCCGCTCCACTCCCCGCCGCCGCCGCG

CGGATGCCAAGCACCAGCTTTCCAGTCCCTTCCAAGTTTCCACTTGGCCC

TGCGGCTGCGGTCTTCGGGAGAGGAGAAACTTTGGGGCCCGCGCCGCGCG

CCGGCGGCACCATGAAGTCAGCGGAGGAAGAACACTATGGCTATGCATCC

TCCAACGTCAGCCCCGCCCTGCCGCTCCCCACGGCGCACTCCACCCTGCC

GGCCCCGTGCCACAACCTTCAGACCTCCACACCGGGCATCATCCCGCCGG

CGGATCACCCCTCGGGGTACGGAGCAGCTTTGGACGGTGGGCCCGCGGGC

TACTTCCTCTCCTCCGGCCACACCAGGCCTGATGGGGCCCCTGCCCTGGA

GAGTCCTCGCATCGAGATAACCTCGTGCTTGGGCCTGTACCACAACAATA

ACCAGTTTTTCCACGATGTGGAGGTGGAAGACGTCCTCCCTAGCTCCAAA

CGGTCCCCCTCCACGGCCACGCTGAGTCTGCCCAGCCTGGAGGCCTACAG

AGACCCCTCGTGCCTGAGCCCGGCCAGCAGCCTGTCCTCCCGGAGCTGCA

ACTCAGAGGCCTCCTCCTACGAGTCCAACTACTCGTACCCGTACGCGTCC

CCCCAGACGTCGCCATGGCAGTCTCCCTGCGTGTCTCCCAAGACCACGGA

CCCCGAGGAGGGCTTTCCCCGCGGGCTGGGGGCCTGCACACTGCTGGGTT

CCCCGCGGCACTCCCCCTCCACCTCGCCCCGCGCCAGCGTCACTGAGGAG

AGCTGGCTGGGTGCCCGCTCCTCCAGACCCGCGTCCCCTTGCAACAAGAG

GAAGTACAGCCTCAACGGCCGGCAGCCGCCCTACTCACCCCACCACTCGC

CCACGCCGTCCCCGCACGGCTCCCCGCGGGTCAGCGTGACCGACGACTCG

TGGTTGGGCAACACCACCCAGTACACCAGCTCGGCCATCGTGGCCGCCAT

CAACGCGCTGACCACCGACAGCAGCCTGGACCTGGGAGATGGCGTCCCTG

TCAAGTCCCGCAAGACCACCCTGGAGCAGCCGCCCTCAGTGGCGCTCAAG

GTGGAGCCCGTCGGGGAGGACCTGGGCAGCCCCCCGCCCCCGGCCGACTT

CGCGCCCGAAGACTACTCCTCTTTCCAGCACATCAGGAAGGGCGGCTTCT

GCGACCAGTACCTGGCGGTGCCGCAGCACCCCTACCAGTGGGCGAAGCCC

AAGCCCCTGTCCCCTACGTCCTACATGAGCCCGACCCTGCCCGCCCTGGA

CTGGCAGCTGCCGTCCCACTCAGGCCCGTATGAGCTTCGGATTGAGGTGC

AGCCCAAGTCCCACCACCGAGCCCACTACGAGACGGAGGGCAGCCGGGGG
```

```
                                    -continued
GCCGTGAAGGCGTCGGCCGGAGGACACCCCATCGTGCAGCTGCATGGCTA

CTTGGAGAATGAGCCGCTGATGCTGCAGCTTTTCATTGGGACGGCGGACG

ACCGCCTGCTGCGCCCGCACGCCTTCTACCAGGTGCACCGCATCACAGGG

AAGACCGTGTCCACCACCAGCCACGAGGCCATCCTCTCCAACACCAAAGT

CCTGGAGATCCCACTCCTGCCGGAGAACAGCATGCGAGCCGTCATTGACT

GTGCCGGAATCCTGAAACTCAGAAACTCCGACATTGAACTTCGGAAAGGA

GAGACGGACATCGGGAGGAAGAACACACGGGTACGGCTGGTGTTCCGCGT

TCACGTCCCGCAACCCAGCGGCCGCACGCTGTCCCTGCAGGTGGCCTCCA

ACCCCATCGAATGCTCCCAGCGCTCAGCTCAGGAGCTGCCTCTGGTGGAG

AAGCAGAGCACGGACAGCTATCCGGTCGTGGGCGGGAAGAAGATGGTCCT

GTCTGGCCACAACTTCCTGCAGGACTCCAAGGTCATTTTCGTGGAGAAAG

CCCCAGATGGCCACCATGTCTGGGAGATGGAAGCGAAAACTGACCGGGAC

CTGTGCAAGCCGAATTCTCTGGTGGTTGAGATCCCGCCATTTCGGAATCA

GAGGATAACCAGCCCCGTTCACGTCAGTTTCTACGTCTGCAACGGGAAGA

GAAAGCGAAGCCAGTACCAGCGTTTCACCTACCTTCCCGCCAACGGTAAC

GCCATCTTTCTAACCGTAAGCCGTGAACATGAGCGCGTGGGGTGCTTTTT

CTAAAGACGCAGAAACGACGTCGCCGTAAAGCAGCGTGGCGTGTTGCACA

TTTAACTGTGTGATGTCCCGTTAGTGAGACCGAGCCATCGATGCCCTGAA

AAGGAAAGGAAAAGGGAAGCTTCGGATGCATTTTCCTTGATCCCTGTTGG

GGGTGGGGGCGGGGGTTGCATACTCAGATAGTCACGGTTATTTTGCTTC

TTGCGAATGTATAACAGCCAAGGGGAAAACATGGCTCTTCTGCTCCAAAA

AACTGAGGGGTCCTGGTGTGCATTTGCACCCTAAAGCTGCTTACGGTGA

AAAGGCAAATAGGTATAGCTATTTTGCAGGCACCTTTAGGAATAAACTTT

GCTTTTAAGCCTGTAAAAAAAA
```

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 74), KRPAATKKAGQAKKKK (SEQ ID NO: 75), KKTELQTTNAENKTKKL (SEQ ID NO: 76), KRGIN-DRNFWRGENGRKTR (SEQ ID NO: 77), RKSGKIAAIV-VKRPRK (SEQ ID NO: 78), PKKKRKV (SEQ ID NO: 79), or MDSLLMNRRKFLYQFKNVRWAKGRRETYLC (SEQ ID NO: 80).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (2'—e.g., fluororibose, ribose, 2'-deoxyribose, arabinose, and hexose); and/or modified phosphate groups (e.g., phosphorothioates and 5'-N-phosphoramidite linkages).

The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid or guide polynucleotide (e.g., gRNA), that guides the napDNAbp to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/ Cpf1, Cas12b/C2c1, Cas12c/C2c3, Cas12d/CasY, Cas12e/ CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/ crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The term "nucleobase," "nitrogenous base," or "base," used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (ψ). A "nucleotide" consists of a nucleobase, a five carbon sugar (either ribose or deoxyribose), and at least one phosphate group.

The terms "nucleobase editing domain" or "nucleobase editing protein," as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., an adenine deaminase or an adenosine deaminase; or a cytidine deaminase or a cytosine deaminase). In some embodiments, the nucleobase editing domain is more than one deaminase domain (e.g., an adenine deaminase or an adenosine deaminase and a cytidine or a cytosine deaminase). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse.

As used herein, "obtaining" as in "obtaining an agent" includes synthesizing, purchasing, or otherwise acquiring the agent.

A "patient" or "subject" as used herein refers to a mammalian subject or individual diagnosed with, at risk of having or developing, or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient diagnosed with, at risk or having, predetermined to have, or suspected of having a disease or disorder.

The terms "pathogenic mutation," "pathogenic variant," "disease casing mutation," "disease causing variant," "deleterious mutation," or "predisposing mutation" refers to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The terms "protein," "peptide," "polypeptide," and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

By "Programmed cell death 1 (PDCD1 or PD-1) polypeptide" is meant a protein having at least about 85% amino acid sequence identity to NCBI Accession No. AJS10360.1 or a fragment thereof. The PD-1 protein is thought to be involved in T cell function regulation during immune reactions and in tolerance conditions. An exemplary B2M polypeptide sequence is provided below.

>AJS10360.1 programmed cell death 1 protein
[Homo sapiens]
(SEQ ID NO: 81)
MQIPQAPWPVVWAVLQLGWRPGWFLDSPDRPWNPPTFSPALLVVTEGDNA

TFTCSFSNTSESFVLNWYRMSPSNQTDKLAAFPEDRSQPGQDCRFRVTQL

PNGRDFHMSVVRARRNDSGTYLCGAISLAPKAQIKESLRAELRVTERRAE

VPTAHPSPSPRPAGQFQTLVVGVVGGLLGSLVLLVWVLAVICSRAARGTI

-continued

```
GARRTGQPLKEDPSAVPVFSVDYGELDFQWREKTPEPPVPCVPEQTEYAT

IVFPSGMGTSSPARRGSADGPRSAQPLRPEDGHCSWPL
```

By "Programmed cell death 1 (PDCD1 or PD-1) poly-nucleotide" is meant a nucleic acid molecule encoding a PD-1 polypeptide. The PDCD1 gene encodes an inhibitory cell surface receptor that inhibits T-cell effector functions in an antigen-specific manner. An exemplary PDCD1 nucleic acid sequence is provided below.

```
>AY238517.1 Homo sapiens programmed cell
death 1 (PDCD1) mRNA, complete cds
                                (SEQ ID NO: 82)
ATGCAGATCCCACAGGCGCCCTGGCCAGTCGTCTGGGCGGTGCTACAACT

GGGCTGGCGGCCAGGATGGTTCTTAGACTCCCCAGACAGGCCCTGGAACC

CCCCCACCTTCTCCCCAGCCCTGCTCGTGGTGACCGAAGGGGACAACGCC

ACCTTCACCTGCAGCTTCTCCAACACATCGGAGAGCTTCGTGCTAAACTG

GTACCGCATGAGCCCCAGCAACCAGACGGACAAGCTGGCCGCCTTCCCCG

AGGACCGCAGCCAGCCCGGCCAGGACTGCCGCTTCCGTGTCACACAACTG

CCCAACGGGCGTGACTTCCACATGAGCGTGGTCAGGGCCCGGCGCAATGA

CAGCGGCACCTACCTCTGTGGGGCCATCTCCCTGGCCCCCAAGGCGCAGA

TCAAAGAGAGCCTGCGGGCAGAGCTCAGGGTGACAGAGAGAAGGGCAGAA

GTGCCCACAGCCCACCCCAGCCCCTCACCCAGGCCAGCCGGCCAGTTCCA

AACCCTGGTGGTTGGTGTCGTGGGCGGCCTGCTGGGCAGCCTGGTGCTGC

TAGTCTGGGTCCTGGCCGTCATCTGCTCCCGGGCCGCACGAGGGACAATA

GGAGCCAGGCGCACCGGCCAGCCCCTGAAGGAGGACCCCTCAGCCGTGCC

TGTGTTCTCTGTGGACTATGGGGAGCTGGATTTCCAGTGGCGAGAGAAGA

CCCCGGAGCCCCCCGTGCCCTGTGTCCCTGAGCAGACGGAGTATGCCACC

ATTGTCTTTCCTAGCGGAATGGGCACCTCATCCCCCGCCCGCAGGGGCTC

AGCTGACGGCCCTCGGAGTGCCCAGCCACTGAGGCCTGAGGATGGACACT

GCTCTTGGCCCCTCTGA
```

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell. In other embodiments and without limitation, a reference is an untreated cell that is not subjected to a test condition, or is subjected to placebo or normal saline, medium, buffer, and/or a control vector that does not harbor a polynucleotide of interest.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, at least about 25 amino acids, about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, about 100 nucleotides or about 300 nucleotides or any integer thereabout or therebetween. In some embodiments, a reference sequence is a wild-type sequence of a protein of interest. In other embodiments, a reference sequence is a polynucleotide sequence encoding a wild-type protein.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et ah, Science 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex.

In some embodiments, the RNA-programmable nuclease is the (CRISPR-associated system) Cas9 endonuclease, for example, Cas9 (Casn1) from Streptococcus pyogenes (see, e.g., "Complete genome sequence of an M1 strain of Streptococcus pyogenes." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011).

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. Science 339, 819-823 (2013); *Mali*, P. et ah, RNA-guided human genome engineering via Cas9. Science 339, 823-826 (2013); Hwang, W. Y. et al., Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et al., Genome engineering in *Saccharomyces cerevisiae* using CRISPR-Cas systems. Nucleic acids research (2013); Jiang, W. et ah RNA-guided editing of bacterial genomes using CRISPR-Cas systems. Nature biotechnology 31, 233-239 (2013); the entire contents of each of which are incorporated herein by reference).

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g. formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100 µg/ml denatured salmon sperm DNA (ssDNA). In another embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.10% SDS. Additional variations on these conditions will be readily apparent to those skilled in the art.

Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "split" is meant divided into two or more fragments.

A "split Cas9 protein" or "split Cas9" refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a "reconstituted" Cas9 protein. In particular embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871. PDB file: 5F9R, each of which is incorporated herein by reference. In some embodiments, the protein is divided into two fragments at any C, T, A, or S within a region of SpCas9 between about amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as "splitting" the protein.

In other embodiments, the N-terminal portion of the Cas9 protein comprises amino acids 1-573 or 1-637 *S. pyogenes* Cas9 wild-type (SpCas9) (NCBI Reference Sequence: NC_002737.2, Uniprot Reference Sequence: Q99ZW2) and the C-terminal portion of the Cas9 protein comprises a portion of amino acids 574-1368 or 638-1368 of SpCas9 wild-type, or a corresponding position thereof.

The C-terminal portion of the split Cas9 can be joined with the N-terminal portion of the split Cas9 to form a complete Cas9 protein. In some embodiments, the C-terminal portion of the Cas9 protein starts from where the N-terminal portion of the Cas9 protein ends. As such, in some embodiments, the C-terminal portion of the split Cas9 comprises a portion of amino acids (551-651)-1368 of spCas9. "(551-651)-1368" means starting at an amino acid between amino acids 551-651 (inclusive) and ending at amino acid 1368. For example, the C-terminal portion of the split Cas9 may comprise a portion of any one of amino acid 551-1368, 552-1368, 553-1368, 554-1368, 555-1368, 556-1368, 557-1368, 558-1368, 559-1368, 560-1368, 561-1368, 562-1368, 563-1368, 564-1368, 565-1368, 566-1368, 567-1368, 568-1368, 569-1368, 570-1368, 571-1368, 572-1368, 573-1368, 574-1368, 575-1368, 576-1368, 577-1368, 578-1368, 579-1368, 580-1368, 581-1368, 582-1368, 583-1368, 584-1368, 585-1368, 586-1368, 587-1368, 588-1368, 589-1368, 590-1368, 591-1368, 592-1368, 593-1368, 594-1368, 595-1368, 596-1368, 597-1368, 598-1368, 599-1368, 600-1368, 601-1368, 602-1368, 603-1368, 604-1368, 605-1368, 606-1368, 607-1368, 608-1368, 609-1368, 610-1368, 611-1368, 612-1368, 613-1368, 614-1368, 615-1368, 616-1368, 617-1368, 618-1368, 619-1368, 620-1368, 621-1368, 622-1368, 623-1368, 624-1368, 625-1368, 626-1368, 627-1368, 628-1368, 629-1368, 630-1368, 631-1368, 632-1368, 633-1368, 634-1368, 635-1368, 636-1368, 637-1368, 638-1368, 639-1368, 640-1368, 641-1368, 642-1368, 643-1368, 644-1368, 645-1368, 646-1368, 647-1368, 648-1368, 649-1368, 650-1368, or 651-1368 of spCas9. In some embodiments, the C-terminal portion of the split Cas9 protein comprises a portion of amino acids 574-1368 or 638-1368 of SpCas9.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

COBALT is used, for example, with the following parameters:

a) alignment parameters: Gap penalties-11, -1 and End-Gap penalties-5, -1, b) CDD Parameters: Use RPS BLAST on; Blast E-value 0.003; Find Conserved columns and Recompute on, and c) Query Clustering Parameters: Use query clusters on; Word Size 4; Max cluster distance 0.8; Alphabet Regular.

EMBOSS Needle is used, for example, with the following parameters:

a) Matrix: BLOSUM62;

b) GAP OPEN: 10;

c) GAP EXTEND: 0.5;

d) OUTPUT FORMAT: pair;

e) END GAP PENALTY: false;

f) END GAP OPEN: 10; and g) END GAP EXTEND: 0.5.

The term "target site" refers to a sequence within a nucleic acid molecule that is modified by a nucleobase editor. In one embodiment, the target site is deaminated by a deaminase or a fusion protein comprising a deaminase (e.g., cytidine or adenine deaminase).

By "tet methylcytosine dioxygenase 2 (TET2) polypeptide" is meant a protein having at least about 85% amino acid sequence identity to NCBI Accession No. FM992369.1 or a fragment thereof and having catalytic activity to convert methylcytosine to 5-hydroxymethylcytosine. Defects in the gene have been associated with myeloproliferative disorders, and the enzyme's ability to methylate cytosine contributes to transcriptional regulation. An exemplary TET2 amino acid sequence is provided below.

>CAX30492.1 tet oncogene family member 2
[Homo sapiens]

(SEQ ID NO: 83)

MEQDRTNHVEGNRLSPFLIPSPPICQTEPLATKLQNGSPLPERAHPEVNG

DTKWHSFKSYYGIPCMKGSQNSRVSPDFTQESRGYSKCLQNGGIKRTVSE

PSLSGLLQIKKLKQDQKANGERRNFGVSQERNPGESSQPNVSDLSDKKES

VSSVAQENAVKDFTSFSTHNCSGPENPELQILNEQEGKSANYHDKNIVLL

KNKAVLMPNGATVSASSVEHTHGELLEKTLSQYYPDCVSIAVQKTTSHIN

AINSQATNELSCEITHPSHTSGQINSAQTSNSELPPKPAAVVSEACDADD

ADNASKLAAMLNTCSFQKPEQLQQQKSVFEICPSPAENNIQGTTKLASGE

EFCSGSSSNLQAPGGSSERYLKQNEMNGAYFKQSSVFTKDSFSATTTPPP

PSQLLLSPPPPLPQVPQLPSEGKSTLNGGVLEEHHHYPNQSNTTLLREVK

IEGKPEAPPSQSPNPSTHVCSPSPMLSERPQNNCVNRNDIQTAGTMTVPL

CSEKTRPMSEHLKHNPPIFGSSGELQDNCQQLMRNKEQEILKGRDKEQTR

DLVPPTQHYLKPGWIELKAPRFHQAESHLKRNEASLPSILQYQPNLSNQM

TSKQYTGNSNMPGGLPRQAYTQKTTQLEHKSQMYQVEMNQGQSQGTVDQH

LQFQKPSHQVHFSKTDHLPKAHVQSLCGTRFHFQQRADSQTEKLMSPVLK

QHLNQQASETEPFSNSHLLQHKPHKQAAQTQPSQSSHLPQNQQQQQKLQI

KNKEEILQTFPHPQSNNDQQREGSFFGQTKVEECFHGENQYSKSSEFETH

NVQMGLEEVQNINRRNSPYSQTMKSSACKIQVSCSNNTHLVSENKEQTTH

PELFAGNKTQNLHHMQYFPNNVIPKQDLLHRCFQEQEQKSQQASVLQGYK

NRNQDMSGQQAAQLAQQRYLIHNHANVFPVPDQGGSHTQTPPQKDTQKHA

ALRWHLLQKQEQQQTQQPQTESCHSQMHRPIKVEPGCKPHACMHTAPPEN

KTWKKVTKQENPPASCDNVQQKSIIETMEQHLKQFHAKSLFDHKALTLKS

-continued

QKQVKVEMSGPVTVLTRQTTAAELDSHTPALEQQTTSSEKTPTKRTAASV

LNNNFIESPSKLLDTPIKNLLDTPVKTQYDFPSCRCVEQIIEKDEGPFYTH

LGAGPNVAAIREIMEERFGQKGKAIRIERVIYTGKEGKSSQGCPIAKWVV

RRSSSEEKLLCLVRERAGHTCEAAVIVILILVWEGIPLSLADKLYSELTE

TLRKYGTLTNRRCALNEERTCACQGLDPETCGASFSFGCSWSMYYNGCKF

ARSKIPRKFKLLGDDPKEEEKLESHLQNLSTLMAPTYKKLAPDAYNNQIE

YEHRAPECRLGLKEGRPFSGVTACLDFCAHAHRDLHNMQNGSTLVCTLTR

EDNREFGGKPEDEQLHVLPLYKVSDVDEFGSVEAQEEKKRSGAIQVLSSF

RRKVRMLAEPVKTCRQRKLEAKKAAAEKLSSLENSSNKNEKEKSAPSRTK

QTENASQAKQLAELLRLSGPVMQQSQQPQPLQKQPPQPQQQQRPQQQQPH

HPQTESVNSYSASGSTNPYMRRPNPVSPYPNSSHTSDIYGSTSPMNFYST

SSQAAGSYLNSSNPMNPYPGLLNQNTQYPSYQCNGNLSVDNCSPYLGSYS

PQSQPMDLYRYPSQDPLSKLSLPPIHTLYQPRFGNSQSFTSKYLGYGNQN

MQGDGFSSCTIRPNVHHVGKLPPYPTHEMDGHFMGATSRLPPNLSNPNMD

YKNGEHHSPSHIIHNYSAAPGMFNSSLHALHLQNKENDMLSHTANGLSKM

LPALNHDRTACVQGGLHKLSDANGQEKQPLALVQGVASGAEDNDEVWSDS

EQSFLDPDIGGVAVAPTHGSILIECAKRELHATTPLKNPNRNHPTRISLV

FYQHKSMNEPKHGLALWEAKMAEKAREKEEECEKYGPDYVPQKSHGKKVK

REPAEPHETSEPTYLRFIKSLAERTMSVTTDSTVTTSPYAFTRVTGPYNR

YI

By "tet methylcytosine dioxygenase 2 (TET2) polynucle-otide" is meant a nucleic acid molecule encoding a TET2 polypeptide. The TETs polypeptide encodes a methylcyto-sine dioxygenase and has transcription regulatory activity. An exemplary TET2 nucleic acid is presented below.

>FM992369.1 Homo sapiens mRNA for tet oncogene family member 2
(TET2 gene)

(SEQ ID NO: 84)

CCGTGCCATCCCAACCTCCCACCTCGCCCCCAACCTTCGCGCTTGCTCTGCTTCTTCTCCCA

GGGGTGGAGACCCGCCGAGGTCCCCGGGGTTCCCGAGGGCTGCACCCTTCCCCGCGCTCGCC

AGCCCTGGCCCCTACTCCGCGCTGGTCCGGGCGCACCACTCCCCCCGCGCCACTGCACGGCG

TGAGGGCAGCCCAGGTCTCCACTGCGCGCCCCGCTGTACGGCCCCAGGTGCCGCCGGCCTTT

GTGCTGGACGCCCGGTGCGGGGGGCTAATTCCCTGGGAGCCGGGGCTGAGGGCCCCAGGGCG

GCGGCGCAGGCCGGGGCGGAGCGGGAGGAGGCCGGGGCGGAGCAGGAGGAGGCCCGGGCGGA

GGAGGAGAGCCGGCGGTAGCGGCAGTGGCAGCGGCGAGAGCTTGGGCGGCCGCCGCCGCCTC

CTCGCGAGCGCCGCGCGCCCGGGTCCCGCTCGCATGCAAGTCACGTCCGCCCCCTCGGCGCG

GCCGCCCCGAGACGCCGGCCCCGCTGAGTGATGAGAACAGACGTCAAACTGCCTTATGAATA

TTGATGCGGAGGCTAGGCTGCTTTCGTAGAGAAGCAGAAGGAAGCAAGATGGCTGCCCTTTA

GGATTTGTTAGAAAGGAGACCCGACTGCAACTGCTGGATTGCTGCAAGGCTGAGGGACGAGA

ACGAGGCTGGCAAACATTCAGCAGCACACCCTCTCAAGATTGTTTACTTGCCTTTGCTCCTG

TTGAGTTACAACGCTTGGAAGCAGGAGATGGGCTCAGCAGCAGCCAATAGGACATGATCCAG

GAAGAGCAAATTCAACTAGAGGGCAGCCTTGTGGATGGCCCCGAAGCAAGCCTGATGGAACA

GGATAGAACCAACCATGTTGAGGGCAACAGACTAAGTCCATTCCTGATACCATCACCTCCCA

```
TTTGCCAGACAGAACCTCTGGCTACAAAGCTCCAGAATGGAAGCCCACTGCCTGAGAGAGCT

CATCCAGAAGTAAATGGAGACACCAAGTGGCACTCTTTCAAAAGTTATTATGGAATACCCTG

TATGAAGGGAAGCCAGAATAGTCGTGTGAGTCCTGACTTTACACAAGAAAGTAGAGGGTATT

CCAAGTGTTTGCAAAATGGAGGAATAAAACGCACAGTTAGTGAACCTTCTCTCTCTGGGCTC

CTTCAGATCAAGAAATTGAAACAAGACCAAAAGGCTAATGGAGAAAGACGTAACTTCGGGGT

AAGCCAAGAAAGAAATCCAGGTGAAAGCAGTCAACCAAATGTCTCCGATTTGAGTGATAAGA

AAGAATCTGTGAGTTCTGTAGCCCAAGAAAATGCAGTTAAAGATTTCACCAGTTTTTCAACA

CATAACTGCAGTGGGCCTGAAAATCCAGAGCTTCAGATTCTGAATGAGCAGGAGGGGAAAAG

TGCTAATTACCATGACAAGAACATTGTATTACTTAAAAACAAGGCAGTGCTAATGCCTAATG

GTGCTACAGTTTCTGCCTCTTCCGTGGAACACACACATGGTGAACTCCTGGAAAAAACACTG

TCTCAATATTATCCAGATTGTGTTTCCATTGCGGTGCAGAAAACCACATCTCACATAAATGC

CATTAACAGTCAGGCTACTAATGAGTTGTCCTGTGAGATCACTCACCCATCGCATACCTCAG

GGCAGATCAATTCCGCACAGACCTCTAACTCTGAGCTGCCTCCAAAGCCAGCTGCAGTGGTG

AGTGAGGCCTGTGATGCTGATGATGCTGATAATGCCAGTAAACTAGCTGCAATGCTAAATAC

CTGTTCCTTTCAGAAACCAGAACAACTACAACAACAAAAATCAGTTTTTGAGATATGCCCAT

CTCCTGCAGAAAATAACATCCAGGGAACCACAAAGCTAGCGTCTGGTGAAGAATTCTGTTCA

GGTTCCAGCAGCAATTTGCAAGCTCCTGGTGGCAGCTCTGAACGGTATTTAAAACAAAATGA

AATGAATGGTGCTTACTTCAAGCAAAGCTCAGTGTTCACTAAGGATTCCTTTTCTGCCACTA

CCACACCACCACCACCATCACAATTGCTTCTTTCTCCCCCTCCTCCTCTTCCACAGGTTCCT

CAGCTTCCTTCAGAAGGAAAAAGCACTCTGAATGGTGGAGTTTTAGAAGAACACCACCACTA

CCCCAACCAAAGTAACACAACACTTTTAAGGGAAGTGAAAATAGAGGGTAAACCTGAGGCAC

CACCTTCCCAGAGTCCTAATCCATCTACACATGTATGCAGCCCTTCTCCGATGCTTTCTGAA

AGGCCTCAGAATAATTGTGTGAACAGGAATGACATACAGACTGCAGGGACAATGACTGTTCC

ATTGTGTTCTGAGAAAACAAGACCAATGTCAGAACACCTCAAGCATAACCCACCAATTTTTG

GTAGCAGTGGAGAGCTACAGGACAACTGCCAGCAGTTGATGAGAAACAAAGAGCAAGAGATT

CTGAAGGGTCGAGACAAGGAGCAAACACGAGATCTTGTGCCCCCAACACAGCACTATCTGAA

ACCAGGATGGATTGAATTGAAGGCCCCTCGTTTTCACCAAGCGGAATCCCATCTAAAACGTA

ATGAGGCATCACTGCCATCAATTCTTCAGTATCAACCCAATCTCTCCAATCAAATGACCTCC

AAACAATACACTGGAAATTCCAACATGCCTGGGGGGCTCCCAAGGCAAGCTTACACCCAGAA

AACAACACAGCTGGAGCACAAGTCACAAATGTACCAAGTTGAAATGAATCAAGGGCAGTCCC

AAGGTACAGTGGACCAACATCTCCAGTTCCAAAAACCCTCACACCAGGTGCACTTCTCCAAA

ACAGACCATTTACCAAAAGCTCATGTGCAGTCACTGTGTGGCACTAGATTTCATTTTCAACA

AAGAGCAGATTCCCAAACTGAAAAACTTATGTCCCCAGTGTTGAAACAGCACTTGAATCAAC

AGGCTTCAGAGACTGAGCCATTTTCAAACTCACACCTTTTGCAACATAAGCCTCATAAACAG

GCAGCACAAACACAACCATCCCAGAGTTCACATCTCCCTCAAAACCAGCAACAGCAGCAAAA

ATTACAAATAAAGAATAAAGAGGAAATACTCCAGACTTTTCCTCACCCCCAAAGCAACAATG

ATCAGCAAAGAGAAGGATCATTCTTTGGCCAGACTAAAGTGGAAGAATGTTTTCATGGTGAA

AATCAGTATTCAAAATCAAGCGAGTTCGAGACTCATAATGTCCAAATGGGACTGGAGGAAGT

ACAGAATATAAATCGTAGAAATTCCCCTTATAGTCAGACCATGAAATCAAGTGCATGCAAAA

TACAGGTTTCTTGTTCAAACAATACACACCTAGTTTCAGAGAATAAAGAACAGACTACACAT
```

-continued

```
CCTGAACTTTTTGCAGGAAACAAGACCCAAAACTTGCATCACATGCAATATTTTCCAAATAA

TGTGATCCCAAAGCAAGATCTTCTTCACAGGTGCTTTCAAGAACAGGAGCAGAAGTCACAAC

AAGCTTCAGTTCTACAGGGATATAAAAATAGAAACCAAGATATGTCTGGTCAACAAGCTGCG

CAACTTGCTCAGCAAAGGTACTTGATACATAACCATGCAAATGTTTTTCCTGTGCCTGACCA

GGGAGGAAGTCACACTCAGACCCCTCCCCAGAAGGACACTCAAAAGCATGCTGCTCTAAGGT

GGCATCTCTTACAGAAGCAAGAACAGCAGCAAACACAGCAACCCCAAACTGAGTCTTGCCAT

AGTCAGATGCACAGGCCAATTAAGGTGGAACCTGGATGCAAGCCACATGCCTGTATGCACAC

AGCACCACCAGAAAACAAAACATGGAAAAAGGTAACTAAGCAAGAGAATCCACCTGCAAGCT

GTGATAATGTGCAGCAAAAGAGCATCATTGAGACCATGGAGCAGCATCTGAAGCAGTTTCAC

GCCAAGTCGTTATTTGACCATAAGGCTCTTACTCTCAAATCACAGAAGCAAGTAAAAGTTGA

AATGTCAGGGCCAGTCACAGTTTTGACTAGACAAACCACTGCTGCAGAACTTGATAGCCACA

CCCCAGCTTTAGAGCAGCAAACAACTTCTTCAGAAAAGACACCAACCAAAAGAACAGCTGCT

TCTGTTCTCAATAATTTTATAGAGTCACCTTCCAAATTACTAGATACTCCTATAAAAAATTT

ATTGGATACACCTGTCAAGACTCAATATGATTTCCCATCTTGCAGATGTGTAGAGCAAATTA

TTGAAAAAGATGAAGGTCCTTTTTATACCCATCTAGGAGCAGGTCCTAATGTGGCAGCTATT

AGAGAAATCATGGAAGAAAGGTTTGGACAGAAGGGTAAAGCTATTAGGATTGAAAGAGTCAT

CTATACTGGTAAAGAAGGCAAAAGTTCTCAGGGATGTCCTATTGCTAAGTGGGTGGTTCGCA

GAAGCAGCAGTGAAGAGAAGCTACTGTGTTTGGTGCGGGAGCGAGCTGGCCACACCTGTGAG

GCTGCAGTGATTGTGATTCTCATCCTGGTGTGGGAAGGAATCCCGCTGTCTCTGGCTGACAA

ACTCTACTCGGAGCTTACCGAGACGCTGAGGAAATACGGCACGCTCACCAATCGCCGGTGTG

CCTTGAATGAAGAGAGAACTTGCGCCTGTCAGGGGCTGGATCCAGAAACCTGTGGTGCCTCC

TTCTCTTTTGGTTGTTCATGGAGCATGTACTACAATGGATGTAAGTTTGCCAGAAGCAAGAT

CCCAAGGAAGTTTAAGCTGCTTGGGGATGACCCAAAAGAGGAAGAGAAACTGGAGTCTCATT

TGCAAAACCTGTCCACTCTTATGGCACCAACATATAAGAAACTTGCACCTGATGCATATAAT

AATCAGATTGAATATGAACACAGAGCACCAGAGTGCCGTCTGGGTCTGAAGGAAGGCCGTCC

ATTCTCAGGGGTCACTGCATGTTTGGACTTCTGTGCTCATGCCCACAGAGACTTGCACAACA

TGCAGAATGGCAGCACATTGGTATGCACTCTCACTAGAGAAGACAATCGAGAATTTGGAGGA

AAACCTGAGGATGAGCAGCTTCACGTTCTGCCTTTATACAAAGTCTCTGACGTGGATGAGTT

TGGGAGTGTGGAAGCTCAGGAGGAGAAAAAACGGAGTGGTGCCATTCAGGTACTGAGTTCTT

TTCGGCGAAAAGTCAGGATGTTAGCAGAGCCAGTCAAGACTTGCCGACAAAGGAAACTAGAA

GCCAAGAAAGCTGCAGCTGAAAAGCTTTCCTCCCTGGAGAACAGCTCAAATAAAAATGAAAA

GGAAAAGTCAGCCCCATCACGTACAAAACAAACTGAAAACGCAAGCCAGGCTAAACAGTTGG

CAGAACTTTTGCGACTTTCAGGACCAGTCATGCAGCAGTCCCAGCAGCCCCAGCCTCTACAG

AAGCAGCCACCACAGCCCCAGCAGCAGCAGAGACCCCAGCAGCAGCAGCCACATCACCCTCA

GACAGAGTCTGTCAACTCTTATTCTGCTTCTGGATCCACCAATCCATACATGAGACGGCCCA

ATCCAGTTAGTCCTTATCCAAACTCTTCACACACTTCAGATATCTATGGAAGCACCAGCCCT

ATGAACTTCTATTCCACCTCATCTCAAGCTGCAGGTTCATATTTGAATTCTTCTAATCCCAT

GAACCCTTACCCTGGGCTTTTGAATCAGAATACCCAATATCCATCATATCAATGCAATGGAA

ACCTATCAGTGGACAACTGCTCCCCATATCTGGGTTCCTATTCTCCCCAGTCTCAGCCGATG

GATCTGTATAGGTATCCAAGCCAAGACCCTCTGTCTAAGCTCAGTCTACCACCCATCCATAC

ACTTTACCAGCCAAGGTTTGGAAATAGCCAGAGTTTTACATCTAAATACTTAGGTTATGGAA
```

-continued

```
ACCAAAATATGCAGGGAGATGGTTTCAGCAGTTGTACCATTAGACCAAATGTACATCATGTA

GGGAAATTGCCTCCTTATCCCACTCATGAGATGGATGGCCACTTCATGGGAGCCACCTCTAG

ATTACCACCCAATCTGAGCAATCCAAACATGGACTATAAAAATGGTGAACATCATTCACCTT

CTCACATAATCCATAACTACAGTGCAGCTCCGGGCATGTTCAACAGCTCTCTTCATGCCCTG

CATCTCCAAAACAAGGAGAATGACATGCTTTCCCACACAGCTAATGGGTTATCAAAGATGCT

TCCAGCTCTTAACCATGATAGAACTGCTTGTGTCCAAGGAGGCTTACACAAATTAAGTGATG

CTAATGGTCAGGAAAAGCAGCCATTGGCACTAGTCCAGGGTGTGGCTTCTGGTGCAGAGGAC

AACGATGAGGTCTGGTCAGACAGCGAGCAGAGCTTTCTGGATCCTGACATTGGGGGAGTGGC

CGTGGCTCCAACTCATGGGTCAATTCTCATTGAGTGTGCAAAGCGTGAGCTGCATGCCACAA

CCCCTTTAAAGAATCCCAATAGGAATCACCCCACCAGGATCTCCCTCGTCTTTTACCAGCAT

AAGAGCATGAATGAGCCAAAACATGGCTTGGCTCTTTGGGAAGCCAAAATGGCTGAAAAAGC

CCGTGAGAAAGAGGAAGAGTGTGAAAAGTATGGCCCAGACTATGTGCCTCAGAAATCCCATG

GCAAAAAAGTGAAACGGGAGCCTGCTGAGCCACATGAAACTTCAGAGCCCACTTACCTGCGT

TTCATCAAGTCTCTTGCCGAAAGGACCATGTCCGTGACCACAGACTCCACAGTAACTACATC

TCCATATGCCTTCACTCGGGTCACAGGGCCTTACAACAGATATATATGAAGATATATATGAT

ATCACCCCCTTTTGTTGGTTACCTCACTTGAAAAGACCACAACCAACCTGTCAGTAGTATAG

TTCTCATGACGTGGGCAGTGGGGAAAGGTCACAGTATTCATGACAAATGTGGTGGGAAAAAC

CTCAGCTCACCAGCAACAAAAGAGGTTATCTTACCATAGCACTTAATTTTCACTGGCTCCCA

AGTGGTCACAGATGGCATCTAGGAAAAGACCAAAGCATTCTATGCAAAAGAAGGTGGGGAA

GAAAGTGTTCCGCAATTTACATTTTTAAACACTGGTTCTATTATTGGACGAGATGATATGTA

AATGTGATCCCCCCCCCCCGCTTACAACTCTACACATCTGTGACCACTTTTAATAATATCAA

GTTTGCATAGTCATGGAACACAAATCAAACAAGTACTGTAGTATTACAGTGACAGGAATCTT

AAAATACCATCTGGTGCTGAATATATGATGTACTGAAATACTGGAATTATGGCTTTTTGAAA

TGCAGTTTTTACTGTAATCTTAACTTTTATTTATCAAAATAGCTACAGGAAACATGAATAGC

AGGAAAACACTGAATTTGTTTGGATGTTCTAAGAAATGGTGCTAAGAAAATGGTGTCTTTAA

TAGCTAAAAATTTAATGCCTTTATATCATCAAGATGCTATCAGTGTACTCCAGTGCCCTTGA

ATAATAGGGGTACCTTTTCATTCAAGTTTTTATCATAATTACCTATTCTTACACAAGCTTAG

TTTTTAAAATGTGGACATTTTAAAGGCCTCTGGATTTTGCTCATCCAGTGAAGTCCTTGTAG

GACAATAAACGTATATATGTACATATATACACAAACATGTATATGTGCACACACATGTATAT

GTATAAATATTTTAAATGGTGTTTTAGAAGCACTTTGTCTACCTAAGCTTTGACAACTTGAA

CAATGCTAAGGTACTGAGATGTTTAAAAAACAAGTTTACTTTCATTTTAGAATGCAAAGTTG

ATTTTTTTAAGGAAACAAAGAAAGCTTTTAAAATATTTTTGCTTTTAGCCATGCATCTGCTG

ATGAGCAATTGTGTCCATTTTTAACACAGCCAGTTAAATCCACCATGGGGCTTACTGGATTC

AAGGGAATACGTTAGTCCACAAAACATGTTTTCTGGTGCTCATCTCACATGCTATACTGTAA

AACAGTTTTATACAAAATTGTATGACAAGTTCATTGCTCAAAAATGTACAGTTTTAAGAATT

TTCTATTAACTGCAGGTAATAATTAGCTGCATGCTGCAGACTCAACAAAGCTAGTTCACTGA

AGCCTATGCTATTTTATGGATCATAGGCTCTTCAGAGAACTGAATGGCAGTCTGCCTTTGTG

TTGATAATTATGTACATTGTGACGTTGTCATTTCTTAGCTTAAGTGTCCTCTTTAACAAGAG

GATTGAGCAGACTGATGCCTGCATAAGATGAATAAACAGGGTTAGTTCCATGTGAATCTGTC

AGTTAAAAAGAAACAAAAACAGGCAGCTGGTTTGCTGTGGTGGTTTTAAATCATTAATTTGT
```

```
                          -continued
ATAAAGAAGTGAAAGAGTTGTATAGTAAATTAAATTGTAAACAAAACTTTTTTAATGCAATG

CTTTAGTATTTTAGTACTGTAAAAAAATTAAATATATACATATATATATATATATATATATA

TATATATATGAGTTTGAAGCAGAATTCACATCATGATGGTGCTACTCAGCCTGCTACAAATA

TATCATAATGTGAGCTAAGAATTCATTAAATGTTTGAGTGATGTTCCTACTTGTCATATACC

TCAACACTAGTTTGGCAATAGGATATTGAACTGAGAGTGAAAGCATTGTGTACCATCATTTT

TTTCCAAGTCCTTTTTTTTATTGTTAAAAAAAAAAGCATACCTTTTTTCAATACTTGATTTC

TTAGCAAGTATAACTTGAACTTCAACCTTTTTGTTCTAAAAATTCAGGGATATTTCAGCTCA

TGCTCTCCCTATGCCAACATGTCACCTGTGTTTATGTAAAATTGTTGTAGGTTAATAAATAT

ATTCTTTGTCAGGGATTTAACCCTTTTATTTTGAATCCCTTCTATTTTACTTGTACATGTGC

TGATGTAACTAAAACTAATTTTGTAAATCTGTTGGCTCTTTTTATTGTAAAGAAAGCATTT

TAAAAGTTTGAGGAATCTTTTGACTGTTTCAAGCAGGAAAAAAAAATTACATGAAAATAGAA

TGCACTGAGTTGATAAAGGGAAAAATTGTAAGGCAGGAGTTTGGCAAGTGGCTGTTGGCCAG

AGACTTACTTGTAACTCTCTAAATGAAGTTTTTTTGATCCTGTAATCACTGAAGGTACATAC

TCCATGTGGACTTCCCTTAAACAGGCAAACACCTACAGGTATGGTGTGCAACAGATTGTACA

ATTACATTTTGGCCTAAATACATTTTTGCTTACTAGTATTTAAAATAAATTCTTAATCAGAG

GAGGCCTTTGGGTTTTATTGGTCAAATCTTTGTAAGCTGGCTTTTGTCTTTTTAAAAAATTT

CTTGAATTTGTGGTTGTGTCCAATTTGCAAACATTTCCAAAAATGTTTGCTTTGCTTACAAA

CCACATGATTTTAATGTTTTTTGTATACCATAATATCTAGCCCCAAACATTTGATTACTACA

TGTGCATTGGTGATTTTGATCATCCATTCTTAATATTTGATTTCTGTGTCACCTACTGTCAT

TTGTTAAACTGCTGGCCAACAAGAACAGGAAGTATAGTTTGGGGGGTTGGGGAGAGTTTACA

TAAGGAAGAGAAGAAATTGAGTGGCATATTGTAAATATCAGATCTATAATTGTAAATATAAA

ACCTGCCTCAGTTAGAATGAATGGAAAGCAGATCTACAATTTGCTAATATAGGAATATCAGG

TTGACTATATAGCCATACTTGAAAATGCTTCTGAGTGGTGTCAACTTTACTTGAATGAATTT

TTCATCTTGATTGACGCACAGTGATGTACAGTTCACTTCTGAAGCTAGTGGTTAACTTGTGT

AGGAAACTTTTGCAGTTTGACACTAAGATAACTTCTGTGTGCATTTTTCTATGCTTTTTTAA

AAACTAGTTTCATTTCATTTTCATGAGATGTTTGGTTTATAAGATCTGAGGATGGTTATAAA

TACTGTAAGTATTGTAATGTTATGAATGCAGGTTATTTGAAAGCTGTTTATTATTATATCAT

TCCTGATAATGCTATGTGAGTGTTTTTAATAAAATTTATATTTATTTAATGCACTCTAAGTG

TTGTCTTCCT
```

By "transforming growth factor receptor 2 (TGFBRII) polypeptide" is meant a protein having at least about 85% sequence identity to NCBI Accession No. ABG65632.1 or a fragment thereof and having immunosuppressive activity. An exemplary amino acid sequence is provided below.

```
>ABG65632.1 transforming growth factor beta
receptor II [Homo sapiens]
                             (SEQ ID NO: 85)
MGRGLLRGLWPLHIVLWTRIASTIPPHVQKSVNNDMIVTDNNGAVKFPQL

CKFCDVRFSTCDNQKSCMSNCSITSICEKPQEVCVAVWRKNDENITLETV

CHDPKLPYHDFILEDAASPKCIMKEKKKPGETFFMCSCSSDECNDNIIFS

EEYNTSNPDLLLVIFQVTGISLLPPLGVAISVIIIFYCYRVNRQQKLSST

WETGKTRKLMEFSEHCAIILEDDRSDISSTCANNINHNTELLPIELDTLV
```

```
                              -continued
GKGRFAEVYKAKLKQNTSEQFETVAVKIFPYEEYASWKTEKDIFSDINLK

HENILQFLTAEERKTELGKQYWLITAFHAKGNLQEYLTRHVISWEDLRKL

GSSLARGIAHLHSDHTPCGRPKMPIVHRDLKSSNILVKNDLTCCLCDFGL

SLRLDPTLSVDDLANSGQVGTARYMAPEVLESRMNLENVESFKQTDVYSM

ALVLWEMTSRCNAVGEVKDYEPPFGSKVREHPCVESMKDNVLRDRGRPEI

PSFWLNHQGIQMVCETLTECWDHDPEARLTAQCVAERFSELEHLDRLSGR

SCSEEKIPEDGSLNTTK
```

By "transforming growth factor receptor 2 (TGFBRII) polynucleotide" is meant a nucleic acid that encodes a TGFBRII polypeptide. The TGFBRII gene encodes a transmembrane protein having serine/threonine kinase activity. An exemplary TGFBRII nucleic acid is provided below.

>M85079.1 Human TGF-beta type II receptor mRNA,
complete cds (SEQ ID NO: 86)
GTTGGCGAGGAGTTTCCTGTTTCCCCCGCAGCGCTGAGTTGAAGTTGAGT

GAGTCACTCGCGCGCACGGAGCGACGACACCCCCGCGCGTGCACCCGCTC

GGGACAGGAGCCGGACTCCTGTGCAGCTTCCCTCGGCCGCCGGGGGCCTC

CCCGCGCCTCGCCGGCCTCCAGGCCCCTCCTGGCTGGCGAGCGGGCGCCA

CATCTGGCCCGCACATCTGCGCTGCCGGCCCGGCGCGGGGTCCGGAGAGG

GCGCGGCGCGGAGCGCAGCCAGGGGTCCGGGAAGGCGCCGTCCGTGCGCT

GGGGGCTCGGTCTATGACGAGCAGCGGGGTCTGCCATGGGTCGGGGGCTG

CTCAGGGGCCTGTGGCCGCTGCACATCGTCCTGTGGACGCGTATCGCCAG

CACGATCCCACCGCACGTTCAGAAGTCGGTTAATAACGACATGATAGTCA

CTGACAACAACGGTGCAGTCAAGTTTCCACAACTGTGTAAATTTTGTGAT

GTGAGATTTTCCACCTGTGACAACCAGAAATCCTGCATGAGCAACTGCAG

CATCACCTCCATCTGTGAGAAGCCACAGGAAGTCTGTGTGGCTGTATGGA

GAAAGAATGACGAGAACATAACACTAGAGACAGTTTGCCATGACCCCAAG

CTCCCCTACCATGACTTTATTCTGGAAGATGCTGCTTCTCCAAAGTGCAT

TATGAAGGAAAAAAAAAAGCCTGGTGAGACTTTCTTCATGTGTTCCTGTA

GCTCTGATGAGTGCAATGACAACATCATCTTCTCAGAAGAATATAACACC

AGCAATCCTGACTTGTTGCTAGTCATATTTCAAGTGACAGGCATCAGCCT

CCTGCCACCACTGGGAGTTGCCATATCTGTCATCATCATCTTCTACTGCT

ACCGCGTTAACCGGCAGCAGAAGCTGAGTTCAACCTGGGAAACCGGCAAG

ACGCGGAAGCTCATGGAGTTCAGCGAGCACTGTGCCATCATCCTGGAAGA

TGACCGCTCTGACATCAGCTCCACGTGTGCCAACAACATCAACCACAACA

CAGAGCTGCTGCCCATTGAGCTGGACACCCTGGTGGGGAAAGGTCGCTTT

GCTGAGGTCTATAAGGCCAAGCTGAAGCAGAACACTTCAGAGCAGTTTGA

GACAGTGGCAGTCAAGATCTTTCCCTATGAGGAGTATGCCTCTTGGAAGA

CAGAGAAGGACATCTTCTCAGACATCAATCTGAAGCATGAGAACATACTC

CAGTTCCTGACGGCTGAGGAGCGGAAGACGGAGTTGGGGAAACAATACTG

GCTGATCACCGCCTTCCACGCCAAGGGCAACCTACAGGAGTACCTGACGC

GGCATGTCATCAGCTGGGAGGACCTGCGCAAGCTGGGCAGCTCCCTCGCC

CGGGGGATTGCTCACCTCCACAGTGATCACACTCCATGTGGGAGGCCCAA

GATGCCCATCGTGCACAGGGACCTCAAGAGCTCCAATATCCTCGTGAAGA

ACGACCTAACCTGCTGCCTGTGTGACTTTGGGCTTTCCCTGCGTCTGGAC

CCTACTCTGTCTGTGGATGACCTGGCTAACAGTGGGCAGGTGGGAACTGC

AAGATACATGGCTCCAGAAGTCCTAGAATCCAGGATGAATTTGGAGAATG

CTGAGTCCTTCAAGCAGACCGATGTCTACTCCATGGCTCTGGTGCTCTGG

GAAATGACATCTCGCTGTAATGCAGTGGGAGAAGTAAAAGATTATGAGCC

TCCATTTGGTTCCAAGGTGCGGGAGCACCCCTGTGTCGAAAGCATGAAGG

ACAACGTGTTGAGAGATCGAGGGCGACCAGAAATTCCCAGCTTCTGGCTC

AACCACCAGGGCATCCAGATGGTGTGTGAGACGTTGACTGAGTGCTGGGA

CCACGACCCAGAGGCCCGTCTCACAGCCCAGTGTGTGGCAGAACGCTTCA

-continued
GTGAGCTGGAGCATCTGGACAGGCTCTCGGGGAGGAGCTGCTCGGAGGAG

AAGATTCCTGAAGACGGCTCCCTAAACACTACCAAATAGCTCTTATGGGG

CAGGCTGGGCATGTCCAAAGAGGCTGCCCCTCTCACCAAA

By "T Cell Immunoreceptor with Ig and ITIM Domains (TIGIT) polypeptide" is meant a protein having at least about 85% sequence identity to NCBI Accession No. ACD74757.1 or a fragment thereof and having immuno-modulatory activity. An exemplary TIGIT amino acid sequence is provided below.

>ACD74757.1 T cell immunoreceptor with Ig and
ITIM domains [Homo sapiens]

(SEQ ID NO: 87)
MRWCLLLIWAQGLRQAPLASGMMTGTIETTGNISAEKGGSIILQCHLSST

TAQVTQVNWEQQDQLLAICNADLGWHISPSFKDRVAPGPGLGLTLQSLTV

NDTGEYFCIYHTYPDGTYTGRIFLEVLESSVAEHGARFQIPLLGAMAATL

VVICTAVIVVVALTRKKKALRIHSVEGDLRRKSAGQEEWSPSAPSPPGSC

VQAEAAPAGLCGEQRGEDCAELHDYFNVLSYRSLGNCSFFTETG

By "T Cell Immunoreceptor With Ig And ITIM Domains (TIGIT) polynucleotide" is meant a nucleic acid encoding a TIGIT polypeptide. The TIGIT gene encodes an inhibitory immune receptor that is associated with neoplasia and T cell exhaustion. An exemplary nucleic acid sequence is provided below.

>EU675310.1 Homo sapiens T cell
immunoreceptor with Ig and ITIM domains (TIGIT)
mRNA, complete cds (SEQ ID NO: 88)
CGTCCTATCTGCAGTCGGCTACTTTCAGTGGCAGAAGAGGCCACATCTGC

TTCCTGTAGGCCCTCTGGGCAGAAGCATGCGCTGGTGTCTCCTCCTGATC

TGGGCCCAGGGGCTGAGGCAGGCTCCCCTCGCCTCAGGAATGATGACAGG

CACAATAGAAACAACGGGGAACATTTCTGCAGAGAAAGGTGGCTCTATCA

TCTTACAATGTCACCTCTCCTCCACCACGGCACAAGTGACCCAGGTCAAC

TGGGAGCAGCAGGACCAGCTTCTGGCCATTTGTAATGCTGACTTGGGGTG

GCACATCTCCCCATCCTTCAAGGATCGAGTGGCCCCAGGTCCCGGCCTGG

GCCTCACCCTCCAGTCGCTGACCGTGAACGATACAGGGGAGTACTTCTGC

ATCTATCACACCTACCCTGATGGGACGTACACTGGGAGAATCTTCCTGGA

GGTCCTAGAAAGCTCAGTGGCTGAGCACGGTGCCAGGTTCCAGATTCCAT

TGCTTGGAGCCATGGCCGCGACGCTGGTGGTCATCTGCACAGCAGTCATC

GTGGTGGTCGCGTTGACTAGAAAGAAGAAAGCCCTCAGAATCCATTCTGT

GGAAGGTGACCTCAGGAGAAAATCAGCTGGACAGGAGGAATGGAGCCCCA

GTGCTCCCTCACCCCCAGGAAGCTGTGTCCAGGCAGAAGCTGCACCTGCT

GGGCTCTGTGGAGAGCAGCGGGGAGAGGACTGTGCCGAGCTGCATGACTA

CTTCAATGTCCTGAGTTACAGAAGCCTGGGTAACTGCAGCTTCTTCACAG

AGACTGGTTAGCAACCAGAGGCATCTTCTGG

By "T Cell Receptor Alpha Constant (TRAC) polypep-tide" is meant a protein having at least about 85% amino acid sequence identity to NCBI Accession No. P01848.2 or fragment thereof and having immunomodulatory activity. An exemplary amino acid sequence is provided below.

```
>sp|P01848.2|TRAC_HUMAN RecName: Full = T
cell receptor alpha constant
                              (SEQ ID NO: 89)
IQNPDPAVYQLRDSKSSDKSVCLFTDFDSQTNVSQSKDSDVYITDKTVLD

MRSMDFKSNSAVAWSNKSDFACANAFNNSIIPEDTFFPSPESSCDVKLVE

KSFETDTNLNFQNLSVIGFRILLLKVAGFNLLMTLRLWSS
```

By "T Cell Receptor Alpha Constant (TRAC) polynucleotide" is meant a nucleic acid encoding a TRAC polypeptide. An exemplary TRAC nucleic acid sequence is provided below.

```
>X02592.1 Human mRNA for T-cell receptor alpha
chain (TCR-alpha)
                              (SEQ ID NO: 90)
TTTTGAAACCCTTCAAAGGCAGAGACTTGTCCAGCCTAACCTGCCTGCTG

CTCCTAGCTCCTGAGGCTCAGGGCCCTTGGCTTCTGTCCGCTCTGCTCAG

GGCCCTCCAGCGTGGCCACTGCTCAGCCATGCTCCTGCTGCTCGTCCCAG

TGCTCGAGGTGATTTTTACCCTGGGAGGAACCAGAGCCCAGTCGGTGACC

CAGCTTGGCAGCCACGTCTCTGTCTCTGAAGGAGCCCTGGTTCTGCTGAG

GTGCAACTACTCATCGTCTGTTCCACCATATCTCTTCTGGTATGTGCAAT

ACCCCAACCAAGGACTCCAGCTTCTCCTGAAGTACACATCAGCGGCCACC

CTGGTTAAAGGCATCAACGGTTTTGAGGCTGAATTTAAGAAGAGTGAAAC

CTCCTTCCACCTGACGAAACCCTCAGCCCATATGAGCGACGCGGCTGAGT

ACTTCTGTGCTGTGAGTGATCTCGAACCGAACAGCAGTGCTTCCAAGATA

ATCTTTGGATCAGGGACCAGACTCAGCATCCGGCCAAATATCCAGAACCC

TGACCCTGCCGTGTACCAGCTGAGAGACTCTAAATCCAGTGACAAGTCTG

TCTGCCTATTCACCGATTTTGATTCTCAAACAAATGTGTCACAAAGTAAG

GATTCTGATGTGTATATCACAGACAAAACTGTGCTAGACATGAGGTCTAT

GGACTTCAAGAGCAACAGTGCTGTGGCCTGGAGCAACAAATCTGACTTTG

CATGTGCAAACGCCTTCAACAACAGCATTATTCCAGAAGACACCTTCTTC

CCCAGCCCAGAAAGTTCCTGTGATGTCAAGCTGGTCGAGAAAAGCTTTGA

AACAGATACGAACCTAAACTTTCAAAACCTGTCAGTGATTGGGTTCCGAA

TCCTCCTCCTGAAAGTGGCCGGGTTTAATCTGCTCATGACGCTGCGGCTG

TGGTCCAGCTGAGATCTGCAAGATTGTAAGACAGCCTGTGCTCCCTCGCT

CCTTCCTCTGCATTGCCCCTCTTCTCCCTCTCCAAACAGAGGGAACTCTC

CTACCCCCAAGGAGGTGAAAGCTGCTACCACCTCTGTGCCCCCCCGGTAA

TGCCACCAACTGGATCCTACCCGAATTTATGATTAAGATTGCTGAAGAGC

TGCCAAACACTGCTGCCACCCCCTCTGTTCCCTTATTGCTGCTTGTCACT

GCCTGACATTCACGGCAGAGGCAAGGCTGCTGCAGCCTCCCCTGGCTGTG

CACATTCCCTCCTGCTCCCCAGAGACTGCCTCCGCCATCCCACAGATGAT

GGATCTTCAGTGGGTTCTCTTGGGCTCTAGGTCCTGGAGAATGTTGTGAG

GGGTTTATTTTTTTTTAATAGTGTTCATAAAGAAATACATAGTATTCTTC

TTCTCAAGACGTGGGGGGAAATTATCTCATTATCGAGGCCCTGCTATGCT

GTGTGTCTGGGCGTGTTGTATGTCCTGCTGCCGATGCCTTCATTAAAATG

ATTTGGAA
```

---

As used herein "transduction" means to transfer a gene or genetic material to a cell via a viral vector.

"Transformation," as used herein refers to the process of introducing a genetic change in a cell produced by the introduction of exogenous nucleic acid.

"Transfection" refers to the transfer of a gene or genetical material to a cell via a chemical or physical means.

By "translocation" is meant the rearrangement of nucleic acid segments between non-homologous chromosomes.

As used herein, the terms "treat," treating," "treatment," and the like refer to reducing or ameliorating a disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein.

By "uracil glycosylase inhibitor" or "UGI" is meant an agent that inhibits the uracil-excision repair system. In one embodiment, the agent is a protein or fragment thereof that binds a host uracil-DNA glycosylase and prevents removal of uracil residues from DNA. In an embodiment, a UGI is a protein, a fragment thereof, or a domain that is capable of inhibiting a uracil-DNA glycosylase base-excision repair enzyme. In some embodiments, a UGI domain comprises a wild-type UGI or a modified version thereof. In some embodiments, a UGI domain comprises a fragment of the exemplary amino acid sequence set forth below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of the exemplary UGI sequence provided below. In some embodiments, a UGI comprises an amino acid sequence that is homologous to the exemplary UGI amino acid sequence or fragment thereof, as set forth below. In some embodiments, the UGI, or a portion thereof, is at least 70%, at least 75%, at least 80%, at least 85%, at least 90%, at least 95%, at least 96%, at least 97%, at least 98%, at least 99%, at least 99.5%, at least 99.9%, or 100% identical to a wild-type UGI or a UGI sequence, or portion thereof, as set forth below. An exemplary UGI comprises an amino acid sequence as follows:

```
>sp1P14739IUNGI_BPPB2 Uracil-DNA glycosylase
inhibitor
                              (SEQ ID NO: 91)
MTNLSDIIEKETGKQLVIQESILMLPEEVEEVIGNKPESDILVHTAYDES

TDENVMLLTSDAPEYKPWALVIQDSNGENKIKML
```

The term "vector" refers to a means of introducing a nucleic acid sequence into a cell, resulting in a transformed cell. Vectors include plasmids, transposons, phages, viruses, liposomes, and episome. "Expression vectors" are nucleic acid sequences comprising the nucleotide sequence to be expressed in the recipient cell. Expression vectors may include additional nucleic acid sequences to promote and/or facilitate the expression of the of the introduced sequence such as start, stop, enhancer, promoter, and secretion sequences.

By "zeta chain of T cell receptor associated protein kinase 70 (ZAP70) polypeptide" is meant a protein having at least about 85% amino acid sequence identity to NCBI Accession No. AAH53878.1 and having kinase activity. An exemplary amino acid sequence is provided below.

```
>AAH53878.1 Zeta-chain (TCR) associated
protein kinase 70 kDa [Homo sapiens]
                              (SEQ ID NO: 92)
MPDPAAHLPFFYGSISRAEAEEHLKLAGMADGLFLLRQCLRSLGGYVLSL

VHDVRFHHFPIERQLNGTYAIAGGKAHCGPAELCEFYSRDPDGLPCNLRK

PCNRPSGLEPQPGVFDCLRDAMVRDYVRQTWKLEGEALEQAIISQAPQVE

KLIATTAHERMPWYHSSLTREEAERKLYSGAQTDGKFLLRPRKEQGTYAL

SLIYGKTVYHYLISQDKAGKYCIPEGTKFDTLWQLVEYLKLKADGLIYCL

KEACPNSSASNASGAAAPTLPAHPSTLTHPQRRIDTLNSDGYTPEPARIT

SPDKPRPMPMDTSVYESPYSDPEELKDKKLFLKRDNLLIADIELGCGNFG

SVRQGVYRMRKKQIDVAIKVLKQGTEKADTEEMMREAQIMHQLDNPYIVR

LIGVCQAEALMLVMEMAGGGPLHKFLVGKREEIPVSNVAELLHQVSMGMK

YLEEKNFVHRDLAARNVLLVNRHYAKISDFGLSKALGADDSYYTARSAGK

WPLKWYAPECINFRKFSSRSDVWSYGVTMWEALSYGQKPYKKMKGPEVMA

FIEQGKRMECPPECPPELYALMSDCWIYKWEDRPDFLTVEQRMRACYYSL

ASKVEGPPGSTQKAEAACA
```

By "zeta chain of T cell receptor associated protein kinase 70 (ZAP70) polynucleotide" is meant a nucleic acid encoding a ZAP70 polypeptide. The ZAP70 gene encodes a tyrosine kinase that is involved in T cell development and lymphocyte activation. Absence of functional ZAP10 can lead to a severe combined immunodeficiency characterized by the lack of CD8+ T cells. An exemplary ZAP70 nucleic acid sequence is provided below.

```
>BC053878.1 Homo sapiens zeta-chain (TCR)
associated protein kinase 70 kDa, mRNA
(cDNA clone MGC:61743 IMAGE:5757161), complete cds
                              (SEQ ID NO: 93)
GCTTGCCGGAGCTCAGCAGACACCAGGCCTTCCGGGCAGGCCTGGCCCAC

CGTGGGCCTCAGAGCTGCTGCTGGGGCATTCAGAACCGGCTCTCCATTGG

CATTGGGACCAGAGACCCCGCAAGTGGCCTGTTTGCCTGGACATCCACCT

GTACGTCCCCAGGTTTCGGGAGGCCCAGGGGCGATGCCAGACCCCGCGGC

GCACCTGCCCTTCTTCTACGGCAGCATCTCGCGTGCCGAGGCCGAGGAGC

ACCTGAAGCTGGCGGGCATGGCGGACGGGCTCTTCCTGCTGCGCCAGTGC

CTGCGCTCGCTGGGCGGCTATGTGCTGTCGCTCGTGCACGATGTGCGCTT

CCACCACTTTCCCATCGAGCGCCAGCTCAACGGCACCTACGCCATTGCCG

GCGGCAAAGCGCACTGTGGACCGGCAGAGCTCTGCGAGTTCTACTCGCGC

GACCCCGACGGGCTGCCCTGCAACCTGCGCAAGCCGTGCAACCGGCCGTC

GGGCCTCGAGCCGCAGCCGGGGGGTCTTCGACTGCCTGCGAGACGCCATGG

TGCGTGACTACGTGCGCCAGACGTGGAAGCTGGAGGGCGAGGCCCTGGAG
```

```
-continued
CAGGCCATCATCAGCCAGGCCCCGCAGGTGGAGAAGCTCATTGCTACGAC

GGCCCACGAGCGGATGCCCTGGTACCACAGCAGCCTGACGCGTGAGGAGG

CCGAGCGCAAACTTTACTCTGGGGCGCAGACCGACGGCAAGTTCCTGCTG

AGGCCGCGGAAGGAGCAGGGCACATACGCCCTGTCCCTCATCTATGGGAA

GACGGTGTACCACTACCTCATCAGCCAAGACAAGGCGGGCAAGTACTGCA

TTCCCGAGGGCACCAAGTTTGACACGCTCTGGCAGCTGGTGGAGTATCTG

AAGCTGAAGGCGGACGGGCTCATCTACTGCCTGAAGGAGGCCTGCCCCAA

CAGCAGTGCCAGCAACGCCTCAGGGGCTGCTGCTCCCACACTCCCAGCCC

ACCCATCCACGTTGACTCATCCTCAGAGACGAATCGACACCCTCAACTCA

GATGGATACACCCCTGAGCCAGCACGCATAACGTCCCCAGACAAACCGCG

GCCGATGCCCATGGACACGAGCGTGTATGAGAGCCCCTACAGCGACCCAG

AGGAGCTCAAGGACAAGAAGCTCTTCCTGAAGCGCGATAACCTCCTCATA

GCTGACATTGAACTTGGCTGCGGCAACTTTGGCTCAGTGCGCCAGGGCGT

GTACCGCATGCGCAAGAAGCAGATCGACGTGGCCATCAAGGTGCTGAAGC

AGGGCACGGAGAAGGCAGACACGGAAGAGATGATGCGCGAGGCGCAGATC

ATGCACCAGCTGGACAACCCCTACATCGTGCGGCTCATTGGCGTCTGCCA

GGCCGAGGCCCTCATGCTGGTCATGGAGATGGCTGGGGGCGGGCCGCTGC

ACAAGTTCCTGGTCGGCAAGAGGGAGGAGATCCCTGTGAGCAATGTGGCC

GAGCTGCTGCACCAGGTGTCCATGGGGATGAAGTACCTGGAGGAGAAGAA

CTTTGTGCACCGTGACCTGGCGGCCCGCAACGTCCTGCTGGTTAACCGGC

ACTACGCCAAGATCAGCGACTTTGGCCTCTCCAAAGCACTGGGTGCCGAC

GACAGCTACTACACTGCCCGCTCAGCAGGGAAGTGGCCGCTCAAGTGGTA

CGCACCCGAATGCATCAACTTCCGCAAGTTCTCCAGCCGCAGCGATGTCT

GGAGCTATGGGGTCACCATGTGGGAGGCCTTGTCCTACGGCCAGAAGCCC

TACAAGAAGATGAAAGGGCCGGAGGTCATGGCCTTCATCGAGCAGGGCAA

GCGGATGGAATGCCCACCAGAGTGTCCACCCGAACTGTACGCACTCATGA

GTGACTGCTGGATCTACAAGTGGGAGGATCGCCCCGACTTCCTGACCGTG

GAGCAGCGCATGCGAGCCTGTTACTACAGCCTGGCCAGCAAGGTGGAAGG

GCCCCCAGGCAGCACACAGAAGGCTGAGGCTGCCTGTGCCTGAGCTCCCG

CTGCCCAGGGGAGCCCTCCACACCGGCTCTTCCCCACCCTCAGCCCCACC

CCAGGTCCTGCAGTCTGGCTGAGCCCTGCTTGGTTGTCTCCACACACAGC

TGGGCTGTGGTAGGGGGTGTCTCAGGCCACACCGGCCTTGCATTGCCTGC

CTGGCCCCCTGTCCTCTCTGGCTGGGGAGCAGGGAGGTCCGGGAGGGTGC

GGCTGTGCAGCCTGTCCTGGGCTGGTGGCTCCCGGAGGGCCCTGAGCTGA

GGGCATTGCTTACACGGATGCCTTCCCCTGGGCCCTGACATTGGAGCCTG

GGCATCCTCAGGTGGTCAGGCGTAGATCACCAGAATAAACCCAGCTTCCC

TCTTG
```

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and relying on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the G1 and S phases of the cell cycle, preventing precise repair of DSBs in post-mitotic cells. As a result, it has proven difficult or impossible to alter genomic sequences in a user-defined, programmable manner with high efficiencies in these populations.

BRIEF DESCRIPTION OF THE DRAWINGS

FIG. 1A is an illustration of the TRAC protein, which is a key component in graft versus host disease. FIG. 1B is an illustration of the B2M protein, a component of the MHC class 1 antigen presenting complex present on nucleated cells that can be recognized by a host's CD8+ T cells.

FIG. 2A is a violin plot depicting reduced protein expression as measured by flow cytometry after primary human T cells were electroporated with the indicated mRNA and 41 individual sgRNAs targeting six genes. Individual values shown represent the mean percent of cells with reduced protein expression from two replicates of cells edited with the indicated mRNA and one of the 41 sgRNAs tested. FIG. 2B is a heat map depicting NGS analysis of A•T to G•C conversion at six target sites by eight ABE8 mRNAs and ABE7.10-m/d. Values shown reflect the mean of three independent biological replicates. The position of the edited nucleotide for each target site is shown above the heat map. FIG. 2C is a graph depicting NGS analysis of A•T to G•C conversion in multiplex-edited T cells at site 21 (B2M), site 25 (TRAC), and site 24 (CIITA) after primary human T cells were electroporated with the indicated mRNA and three sgRNAs in multiplex editing format. FIG. 2D (top panel) are graphs protein expression of B2M, CIITA, and TRAC protein as measured by flow cytometry on the cell populations in FIG. 2C five days post-electroporation. Values shown are from a representative donor. FIG. 2D (bottom panel) is a table depicting the percentage of cell expression as measured by flow cytometry following editing with the indicated ABE.

FIG. 5A is a graph depicting A-to-I editing frequencies in targeted RNA amplicons for core ABE 8 constructs as compared to ABE7 and Cas9 (D10A) nickase control. FIG. 5B is a graph depicting A-to-I editing frequencies in targeted RNA amplicons for ABE8 with mutations that have been reported to improve RNA off-target editing.

FIG. 8A is a strip plot depicting whole transcriptome sequencing in HEK293T cells treated with indicated mRNA. The variant allele frequency of transcriptome wide A→G mutations in RNA was observed in replicate HEK293T cell experiments. Total A→G mutations are indicated above each sample. FIG. 8B is a strip plot depicting whole transcriptome sequencing in T cells treated with indicated mRNA. The variant allele frequency of transcriptome wide A-to-G mutations in RNA was observed in three different T cell donors. Total A-to-G mutations are indicated above each sample.

FIG. 9A depicts a representative plot and gate for live, B2M-positive HEK293T cells sorted into single cell clones for the untreated condition. FIG. 9B depicts a representative plot and gate for live, B2M-negative HEK293T cells sorted for the all treated conditions (ABE, CBE or Cas9-treated cells).

FIG. 10 is a table depicting Cas9 variants for accessing all possible PAMs within the NRNN PAM space. Only Cas9 variants that require recognition of three or fewer defined nucleotides in their PAMs are listed. The non-G PAM variants include SpCas9-NRRH, SpCas9-NRTH, and SpCas9-NRCH.

DETAILED DESCRIPTION OF THE INVENTION

Figure 1C:
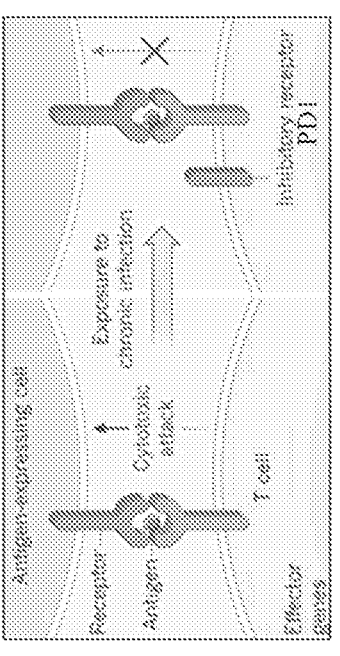
FIG. 1C is an illustration of T cell signaling that leads to expression of the PDCD1 gene, and the resulting PD-1 protein acts to inhibit the T cell signaling.

The present invention features genetically modified immune cells comprising novel adenosine base editors (e.g., ABE8) having enhanced anti-neoplasia activity, resistance to immune suppression, and decreased risk of eliciting a graft-versus-host reaction or host-versus-graft reaction, or a combination thereof. The present invention also features methods for producing and using these modified immune effector cells (e.g., immune effector cells, such as T cells). The present invention also features methods of treating a subject having or having a propensity to develop a neoplasia, graft-versus-host disease (GVHD) or host-versus-graft disease (HVGD) with an effective amount of a modified immune effector cell (e.g., CAR-T cell).

The modification of immune effector cells to express chimeric antigen receptors (CARs) and to knockout or knockdown specific genes to diminish the negative impact that their expression can have on immune cell function is accomplished using a base editor system comprising an adenosine deaminase as described herein.

Autologous, patient-derived chimeric antigen receptor-T cell (CAR-T) therapies have demonstrated remarkable efficacy in treating some hematologic cancers. While these products have led to significant clinical benefit for patients, the need to generate individualized therapies creates substantial manufacturing challenges and financial burdens. Allogeneic CAR-T therapies were developed as a potential solution to these challenges, having similar clinical efficacy profiles to autologous products while treating many patients with cells derived from a single healthy donor, thereby substantially reducing cost of goods and lot-to-lot variability.

Most first-generation allogeneic CAR-Ts use nucleases to introduce two or more targeted genomic DNA double strand breaks (DSBs) in a target T cell population, relying on error-prone DNA repair to generate mutations that knock out target genes in a semi-stochastic manner. Such nuclease-based gene knockout strategies aim to reduce the risk of graft-versus-host-disease (GVHD) and host rejection of CAR-Ts. However, the simultaneous induction of multiple DSBs results in a final cell product containing large-scale genomic rearrangements such as balanced and unbalanced translocations, and a relatively high abundance of local rearrangements including inversions and large deletions. Furthermore, as increasing numbers of simultaneous genetic modifications are made by induced DSBs, considerable genotoxicity is observed in the treated cell population. This has the potential to significantly reduce the cell expansion potential from each manufacturing run, thereby decreasing the number of patients that can be treated per healthy donor.

Base editors (BEs) are a class of emerging gene editing reagents that enable highly efficient, user-defined modification of target genomic DNA without the creation of DSBs. Here, an alternative means of producing allogeneic CAR-T cells is proposed by using base editing technology to reduce or eliminate detectable genomic rearrangements while also improving cell expansion. As shown herein, in contrast to a nuclease-only editing strategy, concurrent modification of three genetic loci by base editing produces highly efficient gene knockouts with no detectable translocation events. In one embodiment, the base editor (e.g., ABE8) is used in multiplex base editing of at least one cell surface targets in T cells (e.g., including, but not limited to, TRAC, B2M, CD7, PDCD1, CBLB and/or CIITA). In one embodiment, an ABE8 is used in multiplex base editing of TRAC, B2M, and CIITA in T cells. Multiplex editing of genes may be useful in the creation of CAR-T cell therapies with improved therapeutic properties. This method addresses known limitations of multiplex-edited T cell products and are a promising development towards the next generation of precision cell-based therapies.

Chimeric Antigen Receptor and Car-T Cells

The invention provides immune cells modified using nucleobase editors described herein that express chimeric antigen receptors (CARs). Modification of immune cells to express a chimeric antigen receptor can enhance an immune cell's immunoreactive activity, wherein the chimeric antigen receptor has an affinity for an epitope on an antigen, wherein the antigen is associated with an altered fitness of an organism. For example, the chimeric antigen receptor can have an affinity for an epitope on a protein expressed in a neoplastic cell. Because the CAR-T cells can act independently of major histocompatibility complex (MHC), activated CAR-T cells can kill the neoplastic cell expressing the antigen. The direct action of the CAR-T cell evades neoplastic cell defensive mechanisms that have evolved in response to MHC presentation of antigens to immune cells.

In some embodiments, the invention provides immune effector cells that express chimeric antigen receptors that target B cells involved in an autoimmune response (e.g., B cells of a subject that express antibodies generated against the subject's own tissues).

Some embodiments comprise autologous immune cell immunotherapy, wherein immune cells are obtained from a subject having a disease or altered fitness characterized by cancerous or otherwise altered cells expressing a surface marker. The obtained immune cells are genetically modified to express a chimeric antigen receptor and are effectively redirected against specific antigens. Thus, in some embodiments, immune cells are obtained from a subject in need of CAR-T immunotherapy. In some embodiments, these autologous immune cells are cultured and modified shortly after they are obtained from the subject. In other embodiments, the autologous cells are obtained and then stored for future use. This practice may be advisable for individuals who may be undergoing parallel treatment that will diminish immune cell counts in the future. In allogeneic immune cell immunotherapy, immune cells can be obtained from a donor other than the subject who will be receiving treatment. The immune cells, after modification to express a chimeric antigen receptor, are administered to a subject for treating a neoplasia. In some embodiments, immune cells to be modified to express a chimeric antigen receptor can be obtained from pre-existing stock cultures of immune cells.

Immune cells and/or immune effector cells can be isolated or purified from a sample collected from a subject or a donor using standard techniques known in the art. For example, immune effector cells can be isolated or purified from a whole blood sample by lysing red blood cells and removing peripheral mononuclear blood cells by centrifugation. The immune effector cells can be further isolated or purified using a selective purification method that isolates the immune effector cells based on cell-specific markers such as CD25, CD3, CD4, CD8, CD28, CD45RA, or CD45RO. In one embodiment, CD25+ is used as a marker to select regulatory T cells. In another embodiment, the invention provides T cells that have targeted gene knockouts at the TCR constant region (TRAC), which is responsible for TCRαβ surface expression. TCRalphabeta-deficient CAR T cells are compatible with allogeneic immunotherapy (Qasim et al., Sci. Transl. Med. 9, eaaj2013 (2017); Valton et al., Mol Ther. 2015 September; 23(9): 1507-1518). If desired, residual TCRalphabeta T cells are removed using Clini-MACS magnetic bead depletion to minimize the risk of GVHD. In another embodiment, the invention provides donor T cells selected ex vivo to recognize minor histocompatibility antigens expressed on recipient hematopoietic cells, thereby minimizing the risk of graft-versus-host disease (GVHD), which is the main cause of morbidity and mortality after transplantation (Warren et al., Blood 2010; 115(19):3869-3878). Another technique for isolating or purifying immune effector cells is flow cytometry. In fluorescence activated cell sorting a fluorescently labelled antibody with affinity for an immune effector cell marker is used to label immune effector cells in a sample. A gating strategy appropriate for the cells expressing the marker is used to segregate the cells. For example, T lymphocytes can be separated from other cells in a sample by using, for example, a fluorescently labeled antibody specific for an immune effector cell marker (e.g., CD4, CD8, CD28, CD45) and corresponding gating strategy. In one embodiment, a CD45 gating strategy is employed. In some embodiments, a gating strategy for other markers specific to an immune effector cell is employed instead of, or in combination with, the CD45 gating strategy.

The immune effector cells contemplated in the invention are effector T cells. In some embodiments, the effector T cell is a naïve CD8$^+$ T cell, a cytotoxic T cell, or a regulatory T (Treg) cell. In some embodiments, the effector T cells are thymocytes, immature T lymphocytes, mature T lymphocytes, resting T lymphocytes, or activated T lymphocytes. In some embodiments the immune effector cell is a CD4$^+$ CD8$^+$ T cell or a CD4$^-$ CD8$^-$ T cell. In some embodiments the immune effector cell is a T helper cell. In some embodiments the T helper cell is a T helper 1 (Th1), a T helper 2 (Th2) cell, or a helper T cell expressing CD4 (CD4+ T cell). In some embodiments, the immune effector cell is any other subset of T cells. The modified immune effector cell may express, in addition to the chimeric antigen receptor, an exogenous cytokine, a different chimeric receptor, or any other agent that would enhance immune effector cell signaling or function. For example, coexpression of the chimeric antigen receptor and a cytokine may enhance the CAR-T cell's ability to lyse a target cell.

Chimeric antigen receptors as contemplated in the present invention comprise an extracellular binding domain, a transmembrane domain, and an intracellular domain. Binding of an antigen to the extracellular binding domain can activate the CAR-T cell and generate an effector response, which includes CAR-T cell proliferation, cytokine production, and other processes that lead to the death of the antigen expressing cell. In some embodiments of the present invention, the chimeric antigen receptor further comprises a linker.

The extracellular binding domain of a chimeric antigen receptor contemplated herein comprises an amino acid sequence of an antibody, or an antigen binding fragment thereof, that has an affinity for a specific antigen. In various embodiments, the CAR specifically binds 5T4. Exemplary anti-5T4 CARs include, without limitation, CART-5T4 (Oxford BioMedica plc) and UCART-5T4 (Cellectis SA).

In various embodiments, the CAR specifically binds Alpha-fetoprotein. Exemplary anti-Alpha-fetoprotein CARs include, without limitation, ET-1402 (Eureka Therapeutics Inc). In various embodiments, the CAR specifically binds Axl. Exemplary anti-Axl CARs include, without limitation, CCT-301-38 (F1 Oncology Inc). In various embodiments, the CAR specifically binds B7H6. Exemplary anti-B7H6 CARs include, without limitation, CYAD-04 (Celyad SA).

In various embodiments, the CAR specifically binds BCMA. Exemplary anti-BCMA CARs include, without limitation, ACTR-087+SEA-BCMA (Seattle Genetics Inc), ALLO-715 (Cellectis SA), ARI-0002 (Institut d'Investigacions Biomediques August Pi I Sunyer), bb-2121 (bluebird bio Inc), bb-21217 (bluebird bio Inc), CART-BCMA (University of Pennsylvania), CT-053 (Carsgen Therapeutics Ltd), Descartes-08 (Cartesian Therapeutics), FCARH-143 (Juno Therapeutics Inc), ICTCAR-032 (Innovative Cellular Therapeutics Co Ltd), IM21 CART (Beijing Immunochina Medical Science & Technology Co Ltd), JCARH-125 (Memorial Sloan-Kettering Cancer Center), KITE-585 (Kite Pharma Inc), LCAR-B38M (Nanjing Legend Biotech Co Ltd), LCAR-B4822M (Nanjing Legend Biotech Co Ltd), MCARH-171 (Memorial Sloan-Kettering Cancer Center), P-BCMA-101 (Poseida Therapeutics Inc), P-BCMA-ALLO1 (Poseida Therapeutics Inc), spCART-269

(Shanghai Unicar-Therapy Bio-medicine Technology Co Ltd), and BCMA02/bb2121 (bluebird bio Inc). The polypeptide sequence of the BCMA02/bb2121 CAR is provided below: IDC-82 DNA

```
                                        (SEQ ID NO: 94)
MALPVTALLLPLALLLHAARPDIVLTQSPPSLAMSLGKRATISCRASESV

TILGSHLIHWYQQKPGQPPTLLIQLASNVQTGVPARFSGSGSRTDFTLTI

DPVEEDDVAVYYCLQSRTIPRTFGGGTKLEIKGSTSGSGKPGSGEGSTKG

QIQLVQSGPELKKPGETVKISCKASGYTFTDYSINWVKRAPGKGLKWMGW

INTETREPAYAYDFRGRFAFSLETSASTAYLQINNLKYEDTATYFCALDY

SYAMDYWGQGTSVTVSSAAATTTPAPRPPTPAPTIASQPLSLRPEACRPA

AGGAVHTRGLDFACDIYIWAPLAGTCGVLLLSLVITLYCKRGRKKLLYIF

KQPFMRPVQTTQEEDGCSCRFPEEEEGGCELRVKFSRSADAPAYQQGQNQ

LYNELNLGRREEYDVLDKRRGRDPEMGGKPRRKNPQEGLYNELQKDKMAE

AYSEIGMKGERRRGKGHDGLYQGLSTATKDTYDALHMQALPPR
```

In various embodiments, the CAR specifically binds CCK2R. Exemplary anti-CCK2R CARs include, without limitation, anti-CCK2R CAR-T adaptor molecule (CAM)+ anti-FITC CAR T-cell therapy (cancer), Endocyte/Purdue (Purdue University), In various embodiments, the CAR specifically binds a CD antigen. Exemplary anti-CD antigen CARs include, without limitation, VM-802 (ViroMed Co Ltd). In various embodiments, the CAR specifically binds CD123. Exemplary anti-CD123 CARs include, without limitation, MB-102 (Fortress Biotech Inc), RNA CART123 (University of Pennsylvania), SFG-iMC-CD123.zeta (Bellicum Pharmaceuticals Inc), and UCART-123 (Cellectis SA). In various embodiments, the CAR specifically binds CD133. Exemplary anti-CD133 CARs include, without limitation, KD-030 (Nanjing Kaedi Biotech Inc). In various embodiments, the CAR specifically binds CD138. Exemplary anti-CD138 CARs include, without limitation, ATL-CAR.CD138 (UNC Lineberger Comprehensive Cancer Center) and CART-138 (Chinese PLA General Hospital). In various embodiments, the CAR specifically binds CD171. Exemplary anti-CD171 CARs include, without limitation, JCAR-023 (Juno Therapeutics Inc). In various embodiments, the CAR specifically binds CD19. Exemplary anti-CD19 CARs include, without limitation, 1928z-41BBL (Memorial Sloan-Kettering Cancer Center), 1928z-E27 (Memorial Sloan-Kettering Cancer Center), 19-28z-T2 (Guangzhou Institutes of Biomedicine and Health), 4G7-CARD (University College London), 4SCAR19 (Shenzhen Geno-Immune Medical Institute), ALLO-501 (Pfizer Inc), ATA-190 (QIMR Berghofer Medical Research Institute), AUTO-1 (University College London), AVA-008 (Avacta Ltd), axicabtagene ciloleucel (Kite Pharma Inc), BG-T19 (Guangzhou Bio-gene Technology Co Ltd), BinD-19 (Shenzhen BinDeBio Ltd.), BPX-401 (Bellicum Pharmaceuticals Inc), CAR19h28TM4IBBz (Westmead Institute for Medical Research), C-CAR-0I1 (Chinese PLA General Hospital), CD19CART (Innovative Cellular Therapeutics Co Ltd), CIK-CAR.CD19 (Formula Pharmaceuticals Inc), CLIC-1901 (Ottawa Hospital Research Institute), CSG-CD19 (Carsgen Therapeutics Ltd), CTL-119 (University of Pennsylvania), CTX-101 (CRISPR Therapeutics AG), DSCAR-01 (Shanghai Hrain Biotechnology), ET-190 (Eureka Therapeutics Inc), FT-819 (Memorial Sloan-Kettering Cancer Center), ICAR-19 (Immune Cell Therapy Inc), IM19

CAR-T (Beijing Immunochina Medical Science & Technology Co Ltd), JCAR-014 (Juno Therapeutics Inc), JWCAR-029 (MingJu Therapeutics (Shanghai) Co., Ltd), KD-C-19 (Nanjing Kaedi Biotech Inc), LinCART19 (iCell Gene Therapeutics), lisocabtagene maraleucel (Juno Therapeutics Inc), MatchCART (Shanghai Hrain Biotechnology), MB-CART19.1 (Shanghai Children's Medical Center), PBCAR-0191 (Precision BioSciences Inc), PCAR-019 (PersonGen Biomedicine (Suzhou) Co Ltd), pCAR-19B (Chongqing Precision Biotech Co Ltd), PZ-01 (Pinze Lifetechnology Co Ltd), RB-1916 (Refuge Biotechnologies Inc), SKLB-083019 (Chengdu Yinhe Biomedical Co Ltd), spCART-19 (Shanghai Unicar-Therapy Bio-medicine Technology Co Ltd), TBI-1501 (Takara Bio Inc), TC-110 (TCR2 Therapeutics Inc), TI-1007 (Timmune Biotech Inc), tisagenlecleucel (Abramson Cancer Center of the University of Pennsylvania), U-CART (Shanghai Bioray Laboratory Inc), UCART-19 (Wugen Inc), UCART-19 (Cellectis SA), vadacabtagene leraleucel (Memorial Sloan-Kettering Cancer Center), XLCART-001 (Nanjing Medical University), and yinnuokati-19 (Shenzhen Innovation Immunotechnology Co Ltd). In various embodiments, the CAR specifically binds CD2. Exemplary anti-CD2 CARs include, without limitation, UCART-2 (Wugen Inc). In various embodiments, the CAR specifically binds CD20. Exemplary anti-CD20 CARs include, without limitation, ACTR-087 (National University of Singapore), ACTR-707 (Unum Therapeutics Inc), CBM-C20.1 (Chinese PLA General Hospital), MB-106 (Fred Hutchinson Cancer Research Center), and MB-CART20.1 (Miltenyi Biotec GmbH).

In various embodiments, the CAR specifically binds CD22. Exemplary anti-CD22 CARs include, without limitation, anti-CD22 CAR T-cell therapy (B-cell acute lymphoblastic leukemia), University of Pennsylvania (University of Pennsylvania), CD22-CART (Shanghai Unicar-Therapy Bio-medicine Technology Co Ltd), JCAR-018 (Opus Bio Inc), MendCART (Shanghai Hrain Biotechnology), and UCART-22 (Cellectis SA). In various embodiments, the CAR specifically binds CD30. Exemplary anti-CD30 CARs include, without limitation, ATLCAR.CD30 (UNC Lineberger Comprehensive Cancer Center), CBM-C30.1 (Chinese PLA General Hospital), and Hu30-CD28zeta (National Cancer Institute). In various embodiments, the CAR specifically binds CD33. Exemplary anti-CD33 CARs include, without limitation, anti-CD33 CAR gamma delta T-cell therapy (acute myeloid leukemia), TC BioPharm/University College London (University College London), CAR33VH (Opus Bio Inc), CART-33 (Chinese PLA General Hospital), CIK-CAR.CD33 (Formula Pharmaceuticals Inc), UCART-33 (Cellectis SA), and VOR-33 (Columbia University).

In various embodiments, the CAR specifically binds CD38. Exemplary anti-CD38 CARs include, without limitation, UCART-38 (Cellectis SA). In various embodiments, the CAR specifically binds CD38 A2. Exemplary anti-CD38 A2 CARs include, without limitation, T-007 (TNK Therapeutics Inc). In various embodiments, the CAR specifically binds CD4. Exemplary anti-CD4 CARs include, without limitation, CD4CAR (iCell Gene Therapeutics). In various embodiments, the CAR specifically binds CD44. Exemplary anti-CD44 CARs include, without limitation, CAR-CD44v6 (Istituto Scientifico H San Raffaele). In various embodiments, the CAR specifically binds CD5. Exemplary anti-CD5 CARs include, without limitation, CD5CAR (iCell Gene Therapeutics). In various embodiments, the CAR specifically binds CD7. Exemplary anti-CD7 CARs include, without limitation, CAR-pNK (PersonGen Biomedicine (Suzhou) Co Ltd), and CD7.CAR/28zeta CAR T cells (Baylor College of Medicine), UCART7 (Washington University in St Louis).

In various embodiments, the CAR specifically binds CDH17. Exemplary anti-CDH17 CARs include, without limitation, ARB-001.T (Arbele Ltd). In various embodiments, the CAR specifically binds CEA. Exemplary anti-CEA CARs include, without limitation, HORC-020 (Hum-Origin Inc). In various embodiments, the CAR specifically binds Chimeric TGF-beta receptor (CTBR). Exemplary anti-Chimeric TGF-beta receptor (CTBR) CARs include, without limitation, CAR-CTBR T cells (bluebird bio Inc). In various embodiments, the CAR specifically binds Claudin18.2. Exemplary anti-Claudin18.2 CARs include, without limitation, CAR-CLD18 T-cells (Carsgen Therapeutics Ltd) and KD-022 (Nanjing Kaedi Biotech Inc).

In various embodiments, the CAR specifically binds CLL1. Exemplary anti-CLL1 CARs include, without limitation, KITE-796 (Kite Pharma Inc). In various embodiments, the CAR specifically binds DLL3. Exemplary anti-DLL3 CARs include, without limitation, AMG-119 (Amgen Inc). In various embodiments, the CAR specifically binds Dual BCMA/TACI (APRIL). Exemplary anti-Dual BCMA/TACI (APRIL) CARs include, without limitation, AUTO-2 (Autolus Therapeutics Limited). In various embodiments, the CAR specifically binds Dual CD19/CD22. Exemplary anti-Dual CD19/CD22 CARs include, without limitation, AUTO-3 (Autolus Therapeutics Limited) and LCAR-L10D (Nanjing Legend Biotech Co Ltd). In various embodiments, the CAR specifically binds CD19. In various embodiments, the CAR specifically binds Dual CLL1/CD33. Exemplary anti-Dual CLL1/CD33 CARs include, without limitation, ICG-136 (iCell Gene Therapeutics). In various embodiments, the CAR specifically binds Dual EpCAM/CD3. Exemplary anti-Dual EpCAM/CD3 CARs include, without limitation, IKT-701 (Icell Kealex Therapeutics). In various embodiments, the CAR specifically binds Dual ErbB/4ab. Exemplary anti-Dual ErbB/4ab CARs include, without limitation, LEU-001 (King's College London). In various embodiments, the CAR specifically binds Dual FAP/CD3. Exemplary anti-Dual FAP/CD3 CARs include, without limitation, IKT-702 (Icell Kealex Therapeutics). In various embodiments, the CAR specifically binds EBV. Exemplary anti-EBV CARs include, without limitation, TT-18 (Tessa Therapeutics Pte Ltd).

In various embodiments, the CAR specifically binds EGFR. Exemplary anti-EGFR CARs include, without limitation, anti-EGFR CAR T-cell therapy (CBLB MegaTAL, cancer), bluebird bio (bluebird bio Inc), anti-EGFR CAR T-cell therapy expressing CTLA-4 checkpoint inhibitor+PD-1 checkpoint inhibitor mAbs (EGFR-positive advanced solid tumors), Shanghai Cell Therapy Research Institute (Shanghai Cell Therapy Research Institute), CSG-EGFR (Carsgen Therapeutics Ltd), and EGFR-IL12-CART (Pregene (Shenzhen) Biotechnology Co Ltd).

In various embodiments, the CAR specifically binds EGFRvIII. Exemplary anti-EGFRvIII CARs include, without limitation, KD-035 (Nanjing Kaedi Biotech Inc) and UCART-EgfrVIII (Cellectis SA). In various embodiments, the CAR specifically binds Flt3. Exemplary anti-Flt3 CARs include, without limitation, ALLO-819 (Pfizer Inc) and AMG-553 (Amgen Inc). In various embodiments, the CAR specifically binds Folate receptor. Exemplary anti-Folate receptor CARs include, without limitation, EC17/CAR T (Endocyte Inc). In various embodiments, the CAR specifically binds G250. Exemplary anti-G250 CARs include, without limitation, autologous T-lymphocyte cell therapy (G250-scFV-transduced, renal cell carcinoma), Erasmus Medical Center (Daniel den Hoed Cancer Center).

In various embodiments, the CAR specifically binds GD2. Exemplary anti-GD2 CARs include, without limitation, 1RG-CART (University College London), 4SCAR-GD2 (Shenzhen Geno-Immune Medical Institute), C7R-GD2.CART cells (Baylor College of Medicine), CMD-501 (Baylor College of Medicine), CSG-GD2 (Carsgen Therapeutics Ltd), GD2-CART01 (Bambino Gesu Hospital and Research Institute), GINAKIT cells (Baylor College of Medicine), iC9-GD2-CAR-IL-15 T-cells (UNC Lineberger Comprehensive Cancer Center), and IKT-703 (Icell Kealex Therapeutics). In various embodiments, the CAR specifically binds GD2 and MUC1. Exemplary anti-GD2/MUC1 CARs include, without limitation, PSMA CAR-T (University of Pennsylvania).

In various embodiments, the CAR specifically binds GPC3. Exemplary anti-GPC3 CARs include, without limitation, ARB-002.T (Arbele Ltd), CSG-GPC3 (Carsgen Therapeutics Ltd), GLYCAR (Baylor College of Medicine), and TT-14 (Tessa Therapeutics Pte Ltd). In various embodiments, the CAR specifically binds Her2. Exemplary anti-Her2 CARs include, without limitation, ACTR-087+ trastuzumab (Unum Therapeutics Inc), ACTR-707+ trastuzumab (Unum Therapeutics Inc), CIDeCAR (Bellicum Pharmaceuticals Inc), MB-103 (Mustang Bio Inc), RB-H21 (Refuge Biotechnologies Inc), and TT-16 (Baylor College of Medicine). In various embodiments, the CAR specifically binds IL13R. Exemplary anti-IL13R CARs include, without limitation, MB-101 (City of Hope) and YYB-103 (YooYoung Pharmaceuticals Co Ltd). In various embodiments, the CAR specifically binds integrin beta-7. Exemplary anti-integrin beta-7 CARs include, without limitation, MMG49 CAR T-cell therapy (Osaka University). In various embodiments, the CAR specifically binds LC antigen. Exemplary anti-LC antigen CARs include, without limitation, VM-803 (ViroMed Co Ltd) and VM-804 (ViroMed Co Ltd).

In various embodiments, the CAR specifically binds mesothelin. Exemplary anti-mesothelin CARs include, without limitation, CARMA-hMeso (Johns Hopkins University), CSG-MESO (Carsgen Therapeutics Ltd), iCasp9M28z (Memorial Sloan-Kettering Cancer Center), KD-021 (Nanjing Kaedi Biotech Inc), m-28z-T2 (Guangzhou Institutes of Biomedicine and Health), MesoCART (University of Pennsylvania), meso-CAR-T+PD-78 (MirImmune LLC), RB-M1 (Refuge Biotechnologies Inc), and TC-210 (TCR2 Therapeutics Inc).

In various embodiments, the CAR specifically binds MUC1. Exemplary anti-MUC1 CARs include, without limitation, anti-MUC1 CAR T-cell therapy+PD-1 knockout T cell therapy (esophageal cancer/NSCLC), Guangzhou Anjie Biomedical Technology/University of Technology Sydney (Guangzhou Anjie Biomedical Technology Co LTD), ICT-CAR-043 (Innovative Cellular Therapeutics Co Ltd), ICT-CAR-046 (Innovative Cellular Therapeutics Co Ltd), P-MUCIC-101 (Poseida Therapeutics Inc), and TAB-28z (OncoTab Inc). In various embodiments, the CAR specifically binds MUC16. Exemplary anti-MUC16 CARs include, without limitation, 4H1128Z-E27 (Eureka Therapeutics Inc) and JCAR-020 (Memorial Sloan-Kettering Cancer Center).

In various embodiments, the CAR specifically binds nfP2X7. Exemplary anti-nfP2X7 CARs include, without limitation, BIL-022c (Biosceptre International Ltd). In various embodiments, the CAR specifically binds PSCA. Exemplary anti-PSCA CARs include, without limitation, BPX-601 (Bellicum Pharmaceuticals Inc). In various embodiments, the CAR specifically binds PSMA. CIK- CAR.PSMA (Formula Pharmaceuticals Inc), and P-PSMA-101 (Poseida Therapeutics Inc). In various embodiments, the CAR specifically binds RORT. Exemplary anti-RORT CARs include, without limitation, JCAR-024 (Fred Hutchinson Cancer Research Center). In various embodiments, the CAR specifically binds ROR2. Exemplary anti-ROR2 CARs include, without limitation, CCT-301-59 (F1 Oncology Inc). In various embodiments, the CAR specifically binds SLAMF7. Exemplary anti-SLAMF7 CARs include, without limitation, UCART-CS1 (Cellectis SA). In various embodiments, the CAR specifically binds TRBC1. Exemplary anti-TRBC1 CARs include, without limitation, AUTO-4 (Autolus Therapeutics Limited). In various embodiments, the CAR specifically binds TRBC2. Exemplary anti-TRBC2 CARs include, without limitation, AUTO-5 (Autolus Therapeutics Limited). In various embodiments, the CAR specifically binds TSHR. Exemplary anti-TSHR CARs include, without limitation, ICT-CAT-023 (Innovative Cellular Therapeutics Co Ltd). In various embodiments, the CAR specifically binds VEGFR-1. Exemplary anti-VEGFR-1 CARs include, without limitation, SKLB-083017 (Sichuan University).

In various embodiments, the CAR is AT-101 (AbClon Inc); AU-101, AU-105, and AU-180 (Aurora Biopharma Inc); CARMA-0508 (Carisma Therapeutics); CAR-T (Fate Therapeutics Inc); CAR-T (Cell Design Labs Inc); CM-CX1 (Celdara Medical LLC); CMD-502, CMD-503, and CMD-504 (Baylor College of Medicine); CSG-002 and CSG-005 (Carsgen Therapeutics Ltd); ET-1501, ET-1502, and ET-1504 (Eureka Therapeutics Inc); FT-61314 (Fate Therapeutics Inc); GB-7001 (Shanghai GeneChem Co Ltd); IMA-201 (Immatics Biotechnologies GmbH); IMM-005 and IMM-039 (Immunome Inc); ImmuniCAR (TC BioPharm Ltd); NT-0004 and NT-0009 (BioNTech Cell and Gene Therapies GmbH), OGD-203 (OGD2 Pharma SAS), PMC-005B (PharmAbcine), and TI-7007 (Timmune Biotech Inc).

In some embodiments the chimeric antigen receptor comprises an amino acid sequence of an antibody. In some embodiments, the chimeric antigen receptor comprises the amino acid sequence of an antigen binding fragment of an antibody. The antibody (or fragment thereof) portion of the extracellular binding domain recognizes and binds to an epitope of an antigen. In some embodiments, the antibody fragment portion of a chimeric antigen receptor is a single chain variable fragment (scFv). An scFV comprises the light and variable fragments of a monoclonal antibody. In other embodiments, the antibody fragment portion of a chimeric antigen receptor is a multichain variable fragment, which can comprise more than one extracellular binding domains and therefore bind to more than one antigen simultaneously. In a multiple chain variable fragment embodiment, a hinge region may separate the different variable fragments, providing necessary spatial arrangement and flexibility.

In other embodiments, the antibody portion of a chimeric antigen receptor comprises at least one heavy chain and at least one light chain. In some embodiments, the antibody portion of a chimeric antigen receptor comprises two heavy chains, joined by disulfide bridges and two light chains, wherein the light chains are each joined to one of the heavy chains by disulfide bridges. In some embodiments, the light chain comprises a constant region and a variable region. Complementarity determining regions residing in the variable region of an antibody are responsible for the antibody's affinity for a particular antigen. Thus, antibodies that recognize different antigens comprise different complementarity determining regions. Complementarity determining regions reside in the variable domains of the extracellular binding domain, and variable domains (i.e., the variable heavy and variable light) can be linked with a linker or, in some embodiments, with disulfide bridges.

In some embodiments, the antigen recognized and bound by the extracellular domain is a protein or peptide, a nucleic acid, a lipid, or a polysaccharide. Antigens can be heterologous, such as those expressed in a pathogenic bacteria or virus. Antigens can also be synthetic; for example, some individuals have extreme allergies to synthetic latex and exposure to this antigen can result in an extreme immune reaction. In some embodiments, the antigen is autologous, and is expressed on a diseased or otherwise altered cell. For example, in some embodiments, the antigen is expressed in a neoplastic cell. In some embodiments, the neoplastic cell is a solid tumor cell. In other embodiments, the neoplastic cell is a hematological cancer, such as a B cell cancer. In some embodiments, the B cell cancer is a lymphoma (e.g., Hodgkins or non-Hodgkins lymphoma) or a leukemia (e.g., B-cell acute lymphoblastic leukemia). Exemplary B-cell lymphomas include Diffuse large B-cell lymphoma (DLBCL), primary mediastinal B-cell lymphoma, follicular lymphoma, Chronic lymphocytic leukemia (CLL), small lymphocytic lymphoma (SLL), mantle cell lymphomas, Marginal zone lymphoma, Burkitt lymphoma, Burkitt-like lymphoma, Lymphoplasmacytic lymphoma (Waldenstrom macroglobulinemia), and hairy cell leukemia. In some embodiments, the B cell cancer is multiple myeloma.

Antibody-antigen interactions are noncovalent interactions resulting from hydrogen bonding, electrostatic or hydrophobic interactions, or from van der Waals forces. The affinity of extracellular binding domain of the chimeric antigen receptor for an antigen can be calculated with the following formula:

$K_A$=[Antibody-Antigen]/[Antibody][Antigen], wherein

[Ab]=molar concentration of unoccupied binding sites on the antibody;

[Ag]=molar concentration of unoccupied binding sites on the antigen; and

[Ab-Ag]=molar concentration of the antibody-antigen complex.

The antibody-antigen interaction can also be characterized based on the dissociation of the antigen from the antibody. The dissociation constant ($K_D$) is the ratio of the association rate to the dissociation rate and is inversely proportional to the affinity constant. Thus, $K_D=1/K_A$. Those skilled in the art will be familiar with these concepts and will know that traditional methods, such as ELISA assays, can be used to calculate these constants.

The transmembrane domain of the chimeric antigen receptors described herein spans the CAR-T cells lipid bilayer cellular membrane and separates the extracellular binding domain and the intracellular signaling domain. In some embodiments, this domain is derived from other receptors having a transmembrane domain, while in other embodiments, this domain is synthetic. In some embodiments, the transmembrane domain may be derived from a non-human transmembrane domain and, in some embodiments, humanized. By "humanized" is meant having the sequence of the nucleic acid encoding the transmembrane domain optimized such that it is more reliably or efficiently expressed in a human subject. In some embodiments, the transmembrane domain is derived from another transmembrane protein expressed in a human immune effector cell. Examples of such proteins include, but are not limited to, subunits of the T cell receptor (TCR) complex, PD1, or any of the Cluster of Differentiation proteins, or other proteins, that are expressed in the immune effector cell and that have a transmembrane domain. In some embodiments, the transmembrane domain will be synthetic, and such sequences will comprise many hydrophobic residues.

The chimeric antigen receptor is designed, in some embodiments, to comprise a spacer between the transmembrane domain and the extracellular domain, the intracellular domain, or both. Such spacers can be 1, 2, 3, 4, 5, 6, 7, 8, 9, 10, 11, 12, 13, 14, 15, 16, 17, 18, 19, or 20 amino acids in length. In some embodiments, the spacer can be 20, 30, 40, 50, 60, 70, 80, 90, or 100 amino acids in length. In still other embodiments the spacer can be between 100 and 500 amino acids in length. The spacer can be any polypeptide that links one domain to another and are used to position such linked domains to enhance or optimize chimeric antigen receptor function.

The intracellular signaling domain of the chimeric antigen receptor contemplated herein comprises a primary signaling domain. In some embodiments, the chimeric antigen receptor comprises the primary signaling domain and a secondary, or co-stimulatory, signaling domain. In some embodiments, the primary signaling domain comprises one or more immunoreceptor tyrosine-based activation motifs, or ITAMs. In some embodiments, the primary signaling domain comprises more than one ITAM. ITAMs incorporated into the chimeric antigen receptor may be derived from ITAMs from other cellular receptors. In some embodiments, the primary signaling domain comprising an ITAM may be derived from subunits of the TCR complex, such as CD3γ, CD3ε, CD3ζ, or CD3δ (see FIG. 1A). In some embodiments, the primary signaling domain comprising an ITAM may be derived from FcRγ, FcRβ, CD5, CD22, CD79a, CD79b, or CD66d. The secondary signaling domain, in some embodiments, is derived from CD28. In other embodiments, the secondary signaling domain is derived from CD2, CD4, CDS, CD8α, CD83, CD134, CD137, ICOS, or CD154.

Provided herein are also nucleic acids that encode the chimeric antigen receptors described herein. In some embodiments, the nucleic acid is isolated or purified. Delivery of the nucleic acids ex vivo can be accomplished using methods known in the art. For example, immune cells obtained from a subject may be transformed with a nucleic acid vector encoding the chimeric antigen receptor. The vector may then be used to transform recipient immune cells so that these cells will then express the chimeric antigen receptor. Efficient means of transforming immune cells include transfection and transduction. Such methods are well known in the art. For example, applicable methods for delivery the nucleic acid molecule encoding the chimeric antigen receptor (and the nucleic acid(s) encoding the base editor) can be found in International Application No. PCT/US2009/040040 and U.S. Pat. Nos. 8,450,112; 9,132,153; and 9,669,058, each of which is incorporated herein in its entirety. Additionally, those methods and vectors described herein for delivering the nucleic acid encoding the base editor (e.g., ABE8) are applicable to delivering the nucleic acid encoding the chimeric antigen receptor.

Some aspects of the present invention provide for immune cells comprising a chimeric antigen and an altered endogenous gene that enhances immune cell function, resistance to immunosuppression or inhibition, or a combination thereof. Allogeneic immune cells expressing an endogenous immune cell receptor as well as a chimeric antigen receptor may recognize and attack host cells, a circumstance termed graft-versus-host disease (GVHD). The alpha component of the immune cell receptor complex is encoded by the TRAC gene, and in some embodiments, this gene is edited such that the alpha subunit of the TCR complex is nonfunctional or absent. Because this subunit is necessary for endogenous immune cell signaling, editing this gene can reduce the risk of graft-versus-host disease (GVHD) caused by allogeneic immune cells.

Figure 1B:
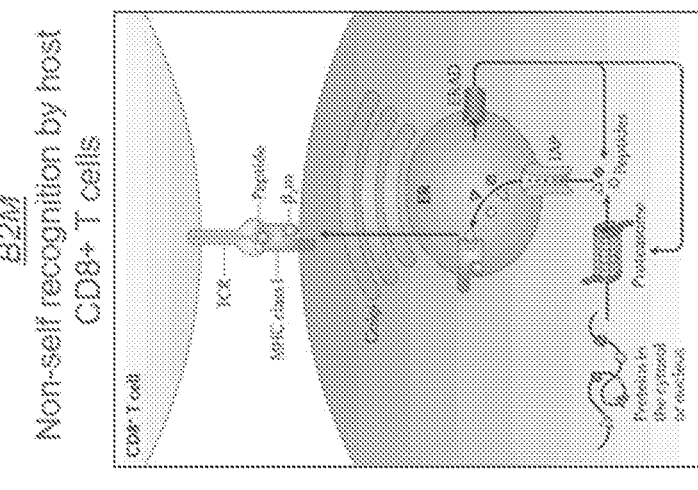
FIGS. 1A and 1B are illustrations of three proteins that impact T cell function.
Figure 1A:
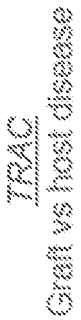
Figure 1A:
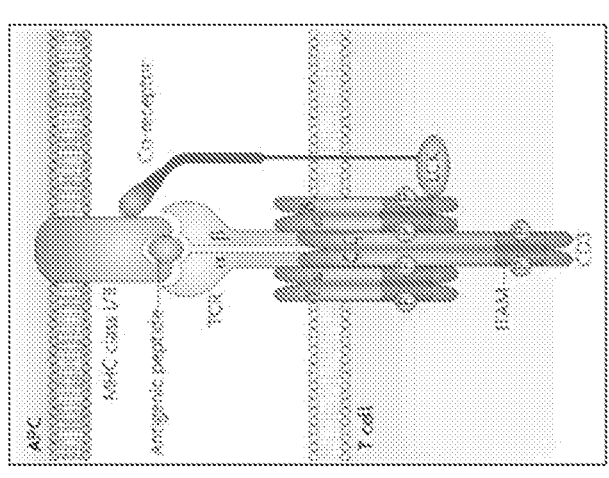

Host immune cells can potentially recognize allogeneic CAR-T cells as non-self and elicit an immune response to remove the non-self cells. B2M is expressed in nearly all nucleated cells and is associated with MHC class I complex (FIG. 1B). Circulating host CD8⁺ T cells can recognize this B2M protein as non-self and kill the allogeneic cells. To overcome this graft rejection, in some embodiments, the B2M gene is edited to either knockout or knockdown expression.

In some embodiments of the present invention, the PDCD1 gene is edited in the CAR-T cell to knockout or knockdown expression. The PDCD1 gene encodes the cell surface receptor PD-1, an immune system checkpoint expressed in immune cells, and it is involved in reducing autoimmunity by promoting apoptosis of antigen specific immune cells. By knocking out or knocking down expression of the PDCD1 gene, the modified CAR-T cells are less likely to apoptose, are more likely to proliferate, and can escape the programmed cell death immune checkpoint.

The CBLB gene encodes an E3 ubiquitin ligase that plays a significant role in inhibiting immune effector cell activation. Referring to FIG. 1C, the CBLB protein favors the signaling pathway resulting in immune effector cell tolerance and actively inhibits signaling that leads to immune effector cell activation. Because immune effector cell activation is necessary for the CAR-T cells to proliferate in vivo post-transplant, in some embodiments of the present invention the CBLB is edited to knockout or knockdown expression.

In some embodiments, editing of genes to enhance the function of the immune cell or to reduce immunosuppression or inhibition can occur in the immune cell before the cell is transformed to express a chimeric antigen receptor. In other aspects, editing of genes to enhance the function of the immune cell or to reduce immunosuppression or inhibition can occur in a CAR-T cell, i.e., after the immune cell has been transformed to express a chimeric antigen receptor. In some embodiments, an immune cell comprises a chimeric antigen receptor and an edited TRAC, B2M, PDCD1, CD7, CIITA, CBLB gene, or a combination thereof, wherein expression of the edited gene is either knocked out or knocked down.

In some embodiments, an immune cell comprises a chimeric antigen receptor and an edited TRAC gene, wherein expression of the edited gene is either knocked out or knocked down. In some embodiments, an immune cell comprises a chimeric antigen receptor and an edited TRAC gene and one or more of B2M, PDCD1, CD7, CIITA, and/or CBLB genes, wherein expression of the edited genes is either knocked out or knocked down. In some embodiments, an immune cell comprises a chimeric antigen receptor and edited TRAC and B2M genes, wherein expression of the edited genes is either knocked out or knocked down. In some embodiments, an immune cell comprises a chimeric antigen receptor and edited TRAC and PDCD1 genes, wherein expression of the edited genes is either knocked out or knocked down. In some embodiments, an immune cell comprises a chimeric antigen receptor and edited TRAC and CBLB genes, wherein expression of the edited genes is either knocked out or knocked down. In some embodiments, an immune cell comprises a chimeric antigen receptor and edited TRAC and CD7 genes, wherein expression of the edited genes is either knocked out or knocked down. In some embodiments, an immune cell comprises a chimeric antigen receptor and edited TRAC and CIITA genes, wherein expression of the edited genes is either knocked out or knocked down. In some embodiments, an immune cell comprises a chimeric antigen receptor and edited TRAC, B2M, and PDCD1 genes, wherein expression of the edited genes is either knocked out or knocked down. In some embodiments, an immune cell comprises a chimeric antigen receptor and edited TRAC, B2M, and CBLB genes, wherein expression of the edited genes is either knocked out or knocked down. In some embodiments, an immune cell or immune effector cell comprises a chimeric antigen receptor and edited TRAC, PDCD1, and CBLB genes, wherein expression of the edited genes is either knocked out or knocked down. In some embodiments, an immune cell comprises a chimeric antigen receptor and edited TRAC, B2M, and CIITA genes, wherein expression of the edited genes is either knocked out or knocked down. In some embodiments, an immune cell comprises a chimeric antigen receptor and edited TRAC, B2M, and CD7 genes, wherein expression of the edited genes is either knocked out or knocked down. In some embodiments, an immune cell comprises a chimeric antigen receptor and edited TRAC, PDCD1, and CD7 genes, wherein expression of the edited genes is either knocked out or knocked down. In some embodiments, an immune cell comprises a chimeric antigen receptor and edited TRAC, PDCD1, and CIITA genes, wherein expression of the edited genes is either knocked out or knocked down. In some embodiments, an immune cell comprises a chimeric antigen receptor and edited TRAC, PDCD1, and CBLB genes, wherein expression of the edited genes is either knocked out or knocked down. In some embodiments, an immune cell comprises a chimeric antigen receptor and edited TRAC, CD7, and CIITA genes, wherein expression of the edited genes is either knocked out or knocked down. In some embodiments, an immune cell comprises a chimeric antigen receptor and edited TRAC, CD7, and CBLB genes, wherein expression of the edited genes is either knocked out or knocked down. In some embodiments, an immune cell comprises a chimeric antigen receptor and edited TRAC, CIITA, and CBLB genes, wherein expression of the edited genes is either knocked out or knocked down.

In some embodiments, an immune cell comprises a chimeric antigen and edited TRAC, B2M, PDCD1, and CBLB genes, wherein expression of the edited genes is either knocked out or knocked down. In some embodiments, an immune cell comprises a chimeric antigen and edited TRAC, B2M, PDCD1, and CD7 genes, wherein expression of the edited genes is either knocked out or knocked down. In some embodiments, an immune cell comprises a chimeric antigen and edited TRAC, B2M, CD7, and CIITA genes, wherein expression of the edited genes is either knocked out or knocked down. In some embodiments, an immune cell comprises a chimeric antigen and edited TRAC, B2M, CD7, and CBLB genes, wherein expression of the edited genes is either knocked out or knocked down. In some embodiments, an immune cell comprises a chimeric antigen and edited TRAC, B2M, PDCD1, and CIITA genes, wherein expression of the edited genes is either knocked out or knocked down. In some embodiments, an immune cell comprises a chimeric antigen and edited TRAC, B2M, CBLB, and CIITA genes, wherein expression of the edited genes is either knocked out or knocked down. In some embodiments, an immune cell comprises a chimeric antigen and edited TRAC, PDCD1, CD7, and CIITA genes, wherein expression of the edited genes is either knocked out or knocked down.

136

In some embodiments, an immune cell comprises a chimeric antigen and edited TRAC, PDCD1, CD7, and CBLB genes, wherein expression of the edited genes is either knocked out or knocked down. In some embodiments, an immune cell comprises a chimeric antigen and edited TRAC, PDCD1, CIITA, and CBLB genes, wherein expression of the edited genes is either knocked out or knocked down. In some embodiments, an immune cell comprises a chimeric antigen and edited TRAC, CIITA, CD7, and CBLB genes, wherein expression of the edited genes is either knocked out or knocked down.

In some embodiments, an immune cell comprises a chimeric antigen and edited TRAC, B2M, PDCD1, CD7, and CIITA genes, wherein expression of the edited genes is either knocked out or knocked down. In some embodiments, an immune cell comprises a chimeric antigen and edited TRAC, B2M, PDCD1, CD7, and CBLB genes, wherein expression of the edited genes is either knocked out or knocked down. In some embodiments, an immune cell comprises a chimeric antigen and edited TRAC, B2M, CD7, CIITA, and CBLB genes, wherein expression of the edited genes is either knocked out or knocked down. In some embodiments, an immune cell comprises a chimeric antigen and edited TRAC, B2M, PDCD1, CIITA, and CBLB genes, wherein expression of the edited genes is either knocked out or knocked down. In some embodiments, an immune cell comprises a chimeric antigen and edited TRAC, PDCD1, CD7, CIITA, and CBLB genes, wherein expression of the edited genes is either knocked out or knocked down. In some embodiments, an immune cell comprises a chimeric antigen and edited TRAC, B2M, PDCD1, CD7, CIITA, and CBLB genes, wherein expression of the edited genes is either knocked out or knocked down.

In some embodiments, an immune cell comprises a chimeric antigen receptor and an edited B2M gene, wherein expression of the edited genes is either knocked out or knocked down. In some embodiments, an immune cell comprises a chimeric antigen receptor and an edited B2M gene and one or more of CBLB, PDCD1, CD7, CIITA, and/or TRAC genes, wherein expression of the edited genes is either knocked out or knocked down. In some embodiments, an immune cell comprises a chimeric antigen receptor and edited B2M and PDCD1 genes, wherein expression of the edited genes is either knocked out or knocked down. In some embodiments, an immune cell comprises a chimeric antigen receptor and edited B2M and CBLB genes, wherein expression of the edited genes is either knocked out or knocked down. In some embodiments, an immune cell comprises a chimeric antigen receptor and edited B2M and CIITA genes, wherein expression of the edited genes is either knocked out or knocked down. In some embodiments, an immune cell comprises a chimeric antigen receptor and edited B2M and CD7 genes, wherein expression of the edited genes is either knocked out or knocked down. In some embodiments, an immune cell comprises a chimeric antigen receptor and edited B2M, CIITA, and CBLB genes, wherein expression of the edited genes is either knocked out or knocked down. In some embodiments, an immune cell comprises a chimeric antigen receptor and edited B2M, PDCD1, and CBLB genes, wherein expression of the edited genes is either knocked out or knocked down. In some embodiments, an immune cell comprises a chimeric antigen receptor and edited B2M, PDCD1, and CIITA genes, wherein expression of the edited genes is either knocked out or knocked down. In some embodiments, an immune cell comprises a chimeric antigen receptor and edited B2M, CD7, and CBLB genes, wherein expression of the edited genes is either knocked out or knocked down. In some embodiments, an immune cell comprises a chimeric antigen receptor and edited B2M, CD7, and PDCD1 genes, wherein expression of the edited genes is either knocked out or knocked down. In some embodiments, an immune cell comprises a chimeric antigen receptor and edited B2M, CD7, and CIITA genes, wherein expression of the edited genes is either knocked out or knocked down. In some embodiments, an immune cell comprises a chimeric antigen receptor and edited B2M, PDCD1, CIITA and CBLB genes, wherein expression of the edited genes is either knocked out or knocked down. In some embodiments, an immune cell comprises a chimeric antigen receptor and edited B2M, PDCD1, CIITA and CD7 genes, wherein expression of the edited genes is either knocked out or knocked down. In some embodiments, an immune cell comprises a chimeric antigen receptor and edited B2M, PDCD1, CD7 and CBLB genes, wherein expression of the edited genes is either knocked out or knocked down. In some embodiments, an immune cell comprises a chimeric antigen receptor and edited B2M, PDCD1, CD7, CIITA and CBLB genes, wherein expression of the edited genes is either knocked out or knocked down.

In some embodiments, an immune cell comprises a chimeric antigen receptor and an edited PDCD1 gene, wherein expression of the edited genes is either knocked out or knocked down. In some embodiments, an immune cell comprises a chimeric antigen receptor and an edited PDCD1 gene and one or more of B2M, CBLB, CD7, CIITA, and/or TRAC genes, wherein expression of the edited genes is either knocked out or knocked down. In some embodiments, an immune cell comprises a chimeric antigen receptor and edited PDCD1 and CBLB genes, wherein expression of the edited genes is either knocked out or knocked down. In some embodiments, an immune cell comprises a chimeric antigen receptor and edited PDCD1 and CD7 genes, wherein expression of the edited genes is either knocked out or knocked down. In some embodiments, an immune cell comprises a chimeric antigen receptor and edited PDCD1 and CIITA genes, wherein expression of the edited genes is either knocked out or knocked down. In some embodiments, an immune cell comprises a chimeric antigen receptor and edited PDCD1, CIITA and CBLB genes, wherein expression of the edited genes is either knocked out or knocked down.

In some embodiments, an immune cell comprises a chimeric antigen receptor and an edited CD7, expression of the edited gene is either knocked out or knocked down. In some embodiments, an immune cell comprises a chimeric antigen receptor and an edited CBLB, expression of the edited gene is either knocked out or knocked down. In some embodiments, an immune cell comprises a chimeric antigen receptor and edited CD7 and CIITA genes, wherein expression of the edited genes is either knocked out or knocked down. In some embodiments, an immune cell comprises a chimeric antigen receptor and edited CD7 and CBLB genes, wherein expression of the edited genes is either knocked out or knocked down. In some embodiments, an immune cell comprises a chimeric antigen receptor and edited CD7, PDCD1, and CIITA genes, wherein expression of the edited genes is either knocked out or knocked down. In some embodiments, an immune cell comprises a chimeric antigen receptor and edited CD7, PDCD1, CIITA and CBLB genes, wherein expression of the edited genes is either knocked out or knocked down.

In some embodiments, an immune cell comprises a chimeric antigen receptor and an edited CBLB, expression of the edited gene is either knocked out or knocked down. In some embodiments, an immune cell comprises a chimeric antigen receptor and an edited CBLB gene and one or more of B2M, PDCD1, CD7, CIITA, and/or TRAC genes, wherein expression of the edited genes is either knocked out or knocked down. In some embodiments, an immune cell comprises a chimeric antigen receptor and edited CBLB and CIITA genes, wherein expression of the edited genes is either knocked out or knocked down.

In some embodiments, an immune cell comprises a chimeric antigen receptor and an edited CIITA, expression of the edited gene is either knocked out or knocked down. In some embodiments, an immune cell comprises a chimeric antigen receptor and an edited CBLB gene and one or more of B2M, PDCD1, CD7, CBLB, and/or TRAC genes, wherein expression of the edited genes is either knocked out or knocked down.

In some embodiments, an immune cell, including by not limited to any immune cell comprising any of the aforementioned gene edits, can be edited to generate mutations in other genes that enhance the CAR-T's function or reduce immunosuppression or inhibition of the cell. For example, in some embodiments, an immune cell comprises a chimeric antigen receptor and an edited TGFBR2, ZAP70, NFATc1, TET2 gene, or a combination thereof, wherein expression of the edited gene is either knocked out or knocked down. In some embodiments, an immune cell comprises a chimeric antigen receptor and an edited TGFBR2 gene, wherein expression of the edited gene is knocked out or knocked down. In some embodiments, an immune cell comprises a chimeric antigen receptor and edited TGFBR2 and ZAP70 genes, wherein expression of the edited genes is either knocked out or knocked down. In some embodiments, an immune cell comprises a chimeric antigen receptor and edited TGFBR2 and ZAP70 genes, wherein expression of the edited genes is either knocked out or knocked down. In some embodiments, an immune cell comprises a chimeric antigen receptor and edited TGFBR2 and NFATC1 genes, wherein expression of the edited genes is either knocked out or knocked down. In some embodiments, an immune cell comprises a chimeric antigen receptor and edited TGFBR2 and TET2 genes, wherein expression of the edited genes is either knocked out or knocked down. In some embodiments, an immune cell comprises a chimeric antigen receptor and edited TGFBR2, ZAP70, and NFATC1 genes, wherein expression of the edited genes is either knocked out or knocked down. In some embodiments, an immune cell comprises a chimeric antigen receptor and edited TGFBR2, ZAP70, and TET2 genes, wherein expression of the edited genes is either knocked out or knocked down. In some embodiments, an immune cell comprises a chimeric antigen receptor and edited TGFBR2, NFATC1, and TET2 genes, wherein expression of the edited genes is either knocked out or knocked down. In some embodiments, an immune cell comprises a chimeric antigen and edited TGFBR2, ZAP70, NFATC1, and TET2 genes, wherein expression of the edited genes is either knocked out or knocked down. In some embodiments, an immune cell comprises a chimeric antigen receptor and an edited ZAP70 gene, wherein expression of the edited genes is either knocked out or knocked down. In some embodiments, an immune cell comprises a chimeric antigen receptor and edited ZAP70 and NFATC1 genes, wherein expression of the edited genes is either knocked out or knocked down. In some embodiments, an immune cell comprises a chimeric antigen receptor and edited ZAP70 and TET2 genes, wherein expression of the edited genes is either knocked out or knocked down. In some embodiments, an immune cell comprises a chimeric antigen receptor and edited ZAP70, PDCD1, and TET2 genes, wherein expression of the edited genes is either knocked out or knocked down. In some embodiments, an immune cell comprises a chimeric antigen receptor and an edited PDCD1 gene, wherein expression of the edited genes is either knocked out or knocked down. In some embodiments, an immune cell comprises a chimeric antigen receptor and edited PDCD1 and TET2 genes, wherein expression of the edited genes is either knocked out or knocked down. And in some embodiments, an immune cell comprises a chimeric antigen receptor and an edited TET2, expression of the edited gene is either knocked out or knocked down.

In some embodiments, a chimeric antigen receptor is inserted into the TRAC gene. This has advantages. First, because TRAC is highly expressed in immune cell, the chimeric antigen receptor will be similarly expressed when its construct is designed to insert the chimeric antigen receptor into the TRAC gene such that expression of the receptor is driven by the TRAC promoter. Second, inserting the chimeric antigen receptor into the TRAC gene will knockout TRAC expression. In some embodiments, the gene editing system described herein can be used to insert the chimeric antigen receptor into the TRAC locus. gRNAs specific for the TRAC locus can guide the gene editing system to the locus and initiate double-stranded DNA cleavage. In particular embodiments, the gRNA is used in conjunction with Cas12b. In various embodiments, the gene editing system is used in conjunction with a nucleic acid having a sequence encoding a CAR receptor. Exemplary guide RNAs are provided in the following Table 1A.

TABLE 1A

| TRAC guide RNAs | | |
|---|---|---|
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACAGAGUCUC UCAGCUGGUACAC (SEQ ID NO: 95) | ATTN BhCas12b nuclease | TRAC KO gRNA 1 (Exon 2) |
| GUUCUGUCUUUUGGUCAGGACAACCGUCUAGCUAU AAGUGCUGCAGGGUGUGAGGAAACUCCUAUUGCUG GACGAUGUCUCUUACGAGGCAUUAGCACACCGAUU UUGAUUCUCAAACA (SEQ ID NO: 96) | ATTN BhCas12b nuclease | TRAC KO gRNA 2 (Exon 2) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACUCAAACAA AUGUGCACAAAG (SEQ ID NO: 97) | ATTN BhCas12b nuclease | TRAC KO gRNA 3 (Exon 2) |

TABLE 1A-continued

| TRAC guide RNAs |
| --- |

| | | | |
| --- | --- | --- | --- |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACUCAAACAA AUGUGUCACAAAG (SEQ ID NO: 98) | ATTN | BhCas12b nuclease | TRAC KO gRNA 4 (Exon 2) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACUUUGAGAA UCAAAAUCGGUA (SEQ ID NO: 99) | ATTN | BhCas12b nuclease | TRAC KO gRNA 5 (Exon 2) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACUGAUGUGU AUAUCACAGACAA (SEQ ID NO: 100) | ATTN | BhCas12b nuclease | TRAC KO gRNA 6 (Exon 2) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCAGUUGCUCCA GGCCACAGCAU (SEQ ID NO: 101) | ATTN | BhCas12b nuclease | TRAC KO gRNA 7 (Exon 2) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACUUCCAGAA GACACCUUCUUCC (SEQ ID NO: 102) | ATTN | BhCas12b nuclease | TRAC KO gRNA 8 (Exon 2) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACCAGAAGAC ACCUUCUUCCCCA (SEQ ID NO: 103) | ATTN | BhCas12b nuclease | TRAC KO gRNA 9 (Exon 2) |
| GUUCUGUCUUUUGGUCAGGACAACCGUCUAGCUAU AAGUGCUGCAGGGUGUGAGAGAAACUCCUAUUGCU GGACGAUGUCUCUUACGAGGCAUUAGCACGGUUCC GAAUCCUCCUGA (SEQ ID NO: 104) | ATTN | BhCas12b nuclease | TRAC KO gRNA 10 (Exon 4) |
| GUUCUGUCUUUUGGUCAGGACAACCGUCUAGCUAU AAGUGCUGCAGGGUGUGAGAAACUCCUAUUGCUGG ACGAUGUCUCUUACGAGGCAUUAGCACGGAACCCA AUCACUGACAGGU (SEQ ID NO: 105) | ATTN | BhCas12b nuclease | TRAC KO gRNA 11 (Exon 4) |

A DNA construct encoding the chimeric antigen receptor and nucleic acid containing extended stretches of TRAC DNA that flank the gRNA targeting sequences. Without being bound by theory, the construct binds to the complementary TRAC sequences, and the chimeric antigen receptor DNA, residing in proximity to the TRAC sequences on the construct is then inserted at the site of the lesion, effectively knocking out the TRAC gene and knocking in the chimeric antigen receptor nucleic acid. Table 1B provide guide RNAs for the TRAC gene that can guide the base editing machinery to the TRAC locus, which enables insertion of the chimeric antigen receptor nucleic acid. The first 11 gRNAS are for BhCas12b nuclease. The second set of 11 are for the BvCas12b nuclease. Scaffold sequence in bold, in first instance. These are all for inserting the CAR at TRAC by creating a double stranded break, and not for base editing.

TABLE 1B

| TRAC guide RNAs | | | |
| --- | --- | --- | --- |
| Guide RNA | SEQ ID NO: | Gene | Exon |
| GUUCUGUCUUUUGGUCAGGACAACCGUCUAGCUAUAAGUGCUGCAGGGU-GUG AGAAACUCCUAUUGCUGGACGAUGUCUCUUACGAGGCAUUAGCACAGA-GUCU CUCAGCUGGUACA | 106 | TRAC gRNA 1 | KO |
| GUUCUGUCUUUUGGUCAGGACAACCGUCUAGCUAUAAGUGCUGCAGGGU-GUG AGAAACUCCUAUUGCUGGACGAUGUCUCUUACGAGG-CAUUAGCACA CCGAUU UUGAUUCUCAAAC | 107 | TRAC gRNA 2 | KO |
| GUUCUGUCUUUUGGUCAGGACAACCGUCUAGCUAUAAGUGCUGCAGGGU-GUG AGAAACUCCUAUUGCUGGACGAUGUCUCUUACGAGGCAUUAGCA-CUGAUUCU CAAACAAAUGUGU | 108 | TRAC gRNA 3 | KO |

TABLE 1B-continued

| Guide RNA | SEQ ID NO: | Gene Exon |
|---|---|---|
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGGCAUUAGCACU-<br>CAAACA<br>AAUGUGUCACAAA | 109 | TRAC KO<br>gRNA 4 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGG-<br>CAUUAGCACGUUUGAG<br>AAUCAAAAUCGGU | 110 | TRAC KO<br>gRNA 5 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGGCAUUAGCACUGAU-<br>GUG<br>UAUAUCACAGACA | 111 | TRAC KO<br>gRNA 6 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGGCAUUAGCACGUUG-<br>CUC<br>CAGGCCACAGCAC | 112 | TRAC KO<br>gRNA 7 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGGCAUUAGCAC-<br>UUCCAGA<br>AGACACCUUCUUC | 113 | TRAC KO<br>gRNA 8 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGG-<br>CAUUAGCACCAGAAGA<br>CACCUUCUUCCCC | 114 | TRAC KO<br>gRNA 9 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGGCAUUAGCACG-<br>GUUCCG<br>AAUCCUCCUCCUG | 115 | TRAC KO<br>gRNA 10 |
| GUUCUGUCUUUUGGUCAGGACAACCGUCUAGCUAUAAGUGCUGCAGGGU-<br>GUG<br>AGAAACUCCUAUUGCUGGACGAUGUCUCUUACGAGGCAUUAGCACG-<br>GAACCC<br>AAUCACUGACAGG | 116 | TRAC KO<br>gRNA 11 |
| GACCUAUAGGGUCAAUGAAUCUGUGCGUGUGCCAUA-<br>AGUAAUUAAAAAUUAC<br>CCACCACAGGAGCACCUGAAAACAGGUGCUUGGCACAGAGUCU-<br>CUCAGCUGG<br>UACA | 117 | TRAC KO<br>gRNA 1 |
| GACCUAUAGGGUCAAUGAAUCUGUGCGUGUGCCAUA-<br>AGUAAUUAAAAAUUAC<br>CCACCACAGGAGCACCUGAAAACAGGUGCUUGGCACACCGAUUUUGAUU-<br>CUC<br>AAAC | 118 | TRAC KO<br>gRNA 2 |
| GACCUAUAGGGUCAAUGAAUCUGUGCGUGUGCCAUA-<br>AGUAAUUAAAAAUUAC<br>CCACCACAGGAGCACCUGAAAACAGGUGCUUGGCACUGAUUCU-<br>CAAACAAAU<br>GUGU | 119 | TRAC KO<br>gRNA 3 |
| GACCUAUAGGGUCAAUGAAUCUGUGCGUGUGCCAUA-<br>AGUAAUUAAAAAUUAC<br>CCACCACAGGAGCACCUGAAAACAGGUGCUUGGCACUCAAACAAAUGU-<br>GUCA<br>CAA | 120 | TRAC KO<br>gRNA 4 |
| GACCUAUAGGGUCAAUGAAUCUGUGCGUGUGCCAUA-<br>AGUAAUUAAAAAUUAC<br>CCACCACAGGAGCACCUGAAAACAGGUGCUUGGCACGUUUGAGAAU-<br>CAAAAU<br>CGGU | 121 | TRAC KO<br>gRNA 5 |

TABLE 1B-continued

TRAC guide RNAs

| Guide RNA | SEQ ID NO: | Gene | Exon |
|---|---|---|---|
| GACCUAUAGGGUCAAUGAAUCUGUGCGUGUGCCAUA-AGUAAUUAAAAAUUAC | 122 | TRAC | KO |
| CCACCACAGGAGCACCUGAAAACAGGUGCUUGGCACUGAUGUGUAUAU-CACA GACA | | gRNA | 6 |
| GACCUAUAGGGUCAAUGAAUCUGUGCGUGUGCCAUA-AGUAAUUAAAAAUUAC | 123 | TRAC | KO |
| CCACCACAGGAGCACCUGAAAACAGGUGCUUGGCACGUUGCUCCAGGC-CACA GCAC | | gRNA | 7 |
| GACCUAUAGGGUCAAUGAAUCUGUGCGUGUGCCAUA-AGUAAUUAAAAAUUAC | 124 | TRAC | KO |
| CCACCACAGGAGCACCUGAAAACAGGUGCUUGGCACUUCCAGAAGACAC-CUU CUUC | | gRNA | 8 |
| GACCUAUAGGGUCAAUGAAUCUGUGCGUGUGCCAUA-AGUAAUUAAAAAUUAC | 125 | TRAC | KO |
| CCACCACAGGAGCACCUGAAAACAGGUGCUUGGCACCAGAAGACACC-UUCUU CCCC | | gRNA | 9 |
| GACCUAUAGGGUCAAUGAAUCUGUGCGUGUGCCAUA-AGUAAUUAAAAAUUAC | 126 | TRAC | KO |
| CCACCACAGGAGCACCUGAAAACAGGUGCUUGGCACGGUUCCGAAUC-CUCCU CCUG | | gRNA | 10 |
| GACCUAUAGGGUCAAUGAAUCUGUGCGUGUGCCAUA-AGUAAUUAAAAAUUAC | 127 | TRAC | KO |
| CCACCACAGGAGCACCUGAAAACAGGUGCUUGGCACGGAACCCAAUCA-CUGA CAGG | | gRNA | 11 |

In some embodiments, a nucleic acid encoding a chimeric antigen receptor of the present invention can be targeted to the TRAC locus using an ABE8. In some embodiments, the chimeric antigen receptor is targeted to the TRAC locus using a CRISPRCas9 base editing system. To produce the gene edits described above, immune cells are collected from a subject and contacted with two or more guide RNAs and a nucleobase editor polypeptide comprising a nucleic acid programmable DNA binding protein (napDNAbp) and an adenosine deaminase (e.g. TadA*8). In some embodiments, the collected immune cells are contacted with at least one nucleic acid, wherein the at least one nucleic acid encodes two or more guide RNAs and a nucleobase editor polypeptide comprising a nucleic acid programmable DNA binding protein (napDNAbp) and an adenosine deaminase (e.g. TadA*8). In some embodiments, the gRNA comprises nucleotide analogs. These nucleotide analogs can inhibit degradation of the gRNA from cellular processes. Table 2 provides target sequences to be used for gRNAs.

TABLE 2

Exemplary Target Sequences

| Target protein | Target residue | gRNA target | SEQ ID NO: | Base editor | Codon change | Residue function |
|---|---|---|---|---|---|---|
| NFATC1 | R118 | CTCGATGCGAGGACTCTCCA | 128 | BE | CGC>CAC | Calcineurin binding |
| | I119 | TCTCGATGCGAGGACTCTCC | 129 | ABE | ATC>ACC | Calcineurin binding |
| | E120 | CATCGAGATAACCTCGTGCT | 130 | ABE | GAG>GGG | Calcineurin binding |
| | S172 | TGGCCGGGCTCAGGCACGAG | 131 | BE | AGC>AAC | Phosphorylation |
| | W396 | GCCCACTGGTAGGGGTGCTG | 132 | ABE | TGG>CGG | Calcineurin binding |
| | R439 | TGGGCTCGGTGGTGGGACTT | 133 | BE | CGA>CAA | DNA Binding |
| | H441 | CGAGCCCACTACGAGACGGA | 134 | ABE | CAC>CGC | DNA Binding |
| | Y442 | CTCGTAGTGGGCTCGGTGGT | 135 | ABE | TAC>CAC | DNA Binding |
| | K452 | GCCGTGAAGGCGTCGGCCGG | 136 | ABE | AAG>GGG | DNA Binding |
| | R540 | GTTTCTGAGTTTCAGGATTC | 137 | BE | AGA>AAA | DNA Binding |
| | R555 | CATCGGGAGGAAGAACACAC | 138 | ABE | AGG>GGG | DNA Binding |
| | K556 | GGAGGAAGAACACACGGGTA | 139 | ABE | AAG>GGG | DNA Binding |
| | Q589 | GAGCGCTGGGCTGCATCAGA | 140 | BE | CAG>CAT | DNA Binding |

TABLE 2-continued

Exemplary Target Sequences

| Target protein | Target residue | gRNA target | SEQ ID NO: | Base editor | Codon change | Residue function |
|---|---|---|---|---|---|---|
| NFATC2 | E114 | TGATCTCGATCCGAGGGCTC | 141 | BE | GAG>AAA | Calcineurin binding |
| | I115 | ACGGAGTGATCTCGATCCGA | 142 | ABE | ATC>ACC | Calcineurin binding |
| | R253 | GCGGAGGCATTCGTGCGCCG | 143 | ABE | AGG>GGG | NLS |
| | S99 | GCCGCGCTCAGAAACTTCTG | 144 | BE | AGC>AAC | Phosphorylation |
| | S107 | GGGCCTCGGGCCTGAGCCCT | 145 | BE | TCG>TTG | Phosphorylation |
| | S148 | CCTCGGGCTGGCGGCCACCC | 146 | BE | AGC>AAC | Phosphorylation |
| | S236 | CCACTCGCCCGTGCCCCGTC | 147 | BE | TCG>TTG | Phosphorylation |
| | S255 | GCATTCGTGCGCCGAGGCCT | 148 | BE | TCG>TTG | Phosphorylation |
| | S268 | GAGCCTCACCCCAGCGCTCC | 149 | BE | TCA>TTA | Phosphorylation |
| | S274 | GAGGGGCTCCGGGAGCGCTG | 150 | BE | AGC>AAC | Phosphorylation |
| | S326 | AGGGCTGGTCTTCCACATCT | 151 | BE | AGC>AAC | Phosphorylation |
| NFATC4 | S213 | GCGGGGAGCCCAGGCCAAAG | 152 | ABE | TCC>CCC | Phosphorylation |
| AKT1 | T305 | GCCACCATGAAGACCTTTTG | 153 | BE | ACC>ATT | Phosphorylation |
| | T312 | TTGCGGCACACCTGAGTACC | 154 | BE | ACA>ATA | Phosphorylation |
| | S473 | GTAGGAGAACTGGGGGAAGT | 155 | ABE | TCC>CCC | Phosphorylation |
| | Y474 | CTCCTACTCGGCCAGCGGCA | 156 | ABE | TAC>TGC | Phosphorylation Phosphorylation |
| AKT2 | T309 | GAAAACCTTCTGTGGGACCC | 157 | BE | ACC>ATT | Phosphorylation |
| | S474 | AGTAGGAGAACTGGGGGAAG | 158 | ABE | TCC>CCC | Phosphorylation |
| BLIMP1 | C608 (ZF2) | GTTGCAAGTCTGACATTTGA | 159 | ABE | TGC>CGC | DNA Binding |
| | C608 (ZF2) | GTTGCAAGTCTGACATTTGA | 159 | BE | TGC>TAC | DNA Binding |
| | H621 (ZF2) | GAAACACTACCTGGTACACA | 160 | BE | CAC>TAT | DNA Binding |
| | C636 (ZF3) | TGTGGCAGACCTACAGTGTA | 161 | BE | TGC>TAC | DNA Binding |
| | C664 (ZF4) | GGGCACACCTTGCATTGGTA | 162 | ABE | TGC>CGC | DNA Binding |
| | Splice site 1 | CTGCGCACCTGGCATTCATG | 163 | BE | | |
| GCN2 kinase (IDO pathway) | Exon 1 SD | CCTACCGGTCCGCAAGCGTC | 164 | BE | Knockout | |
| | Exon 2 SD | ACTCACACATCTGGATAGGT | 165 | BE | Knockout | |
| | Exon 5 SD | GACTTACCTAGACCTTCCTG | 166 | BE | Knockout | |
| CBL-B | C373 | AATCTTACAGAGCTGAAAAG | 167 | BE | TGT>TAT | E3 Ubiquitin Ligase |
| | Y665.1 | CATCATATTCTTCACTTCCA | 168 | ABE | TAT>CAC | |
| | Y665.2 | AAGAATATGATGTTCCTCCC | 169 | ABE | TAT>TGT | |
| | K907 | CCCCTAAACCACGACCGCGC | 170 | ABE | AAA>GGG | |
| | R911 | TCCTGCGCGGTCGTGGTTTA | 171 | BE | CGC>CAC | |
| SHP1 | Y377 | CCCTACTCTGTGACCAACTG | 172 | ABE | TAC>TGC | |
| IRF4 | R96 | CGCAGGCGCGTCTTCCAGGT | 173 | BE | CGC>CAC | DNA Binding |
| | R98 | GCACCGCAGGCGCGTCTTCC | 174 | BE | CGG>CAG | DNA Binding |
| | K103 | GAACAAGAGCAATGACTTTG | 175 | ABE | AAG>GGG | DNA Binding DNA Binding |
| PD1 | Exon 1 STOP | CACCTACCTAAGAACCATCC | 176 | BE | Knockout | |
| | Exon 2 STOP | GGGGTTCCAGGGCCTGTCTG | 177 | BE | Knockout | |
| TET2 | H1386 | GACTTGCACAACATGCAGAA | 178 | BE | CAC>TAC | DNA Binding |
| | R1302 | TTGCCAGAAGCAAGATCCCA | 179 | ABE | AGA>GGG | DNA Binding |
| | S1290 | CCATGAACAACCAAAAGAGA | 180 | ABE | TCA>CCA | DNA Binding |
| SMARCA4 | T353 | TCACCCCCATCCAGAAGCCG | 181 | BE | ACC>ATT | Phosphorylation |
| | S610 | ATCTGGCTGGTCTCGTCCAG | 182 | BE | AGC>ATC | Phosphorylation |
| | S613 | GATGAGCGACCTCCCGGTGA | 183 | ABE | AGC>GGC | Phosphorylation |
| | S695 | AGACAGCGATGACGTCTCTG | 184 | ABE | AGC>GGC | Phosphorylation |
| | S699 | ACGTCTCTGAGGTGGACGCG | 185 | BE | TCT>TTT | Phosphorylation |
| | S1452 | TTAGGGGAGAGTTTCTCGGC | 186 | ABE | TCC>CCC | Phosphorylation |

TABLE 2-continued

Exemplary Target Sequences

| Target protein | Target residue | gRNA target | SEQ ID NO: | Base editor | Codon change | Residue function |
|---|---|---|---|---|---|---|
| | S1575 | GGAGAGTGAGGAGGAGGAAG | 187 | ABE | AGT>GGT | Phosphorylation |
| | S1586 | AAGGCTCCGAATCCGAATCT | 188 | BE | TCC>TTT | Phosphorylation |
| | S1627 | ATCGTCACTCACGACCGGCT | 189 | BE | AGT>AAT | Phosphorylation |
| | S1631 | TGACAGTGAGGAGGAACAAG | 190 | ABE | AGT>GGT | Phosphorylation |
| CDK4 | P173 | CACCCGTGGTTGTTACACTC | 191 | BE | CCC>CTT | |
| ZAP70 | S144 | CATCAGCCAGGCCCCGCAGG | 192 | ABE | AGC>TGC | Phosphorylation |
| | Y292 | GGTGTATCCATCTGAGTTGA | 193 | ABE | TAC>CAC | Phosphorylation |
| | Y292 | GGGTGTATCCATCTGAGTTG | 194 | ABE | TAC>CAC | Phosphorylation |
| | R360 | GCGCAAGAAGCAGATCGACG | 195 | BE | CGC>TGC | Hypermorphic activity |
| | Y598 | TTACTACAGCCTGGCCAGCA | 196 | ABE | TAC>TGC | Phosphorylation |

The adenosine deaminase nucleobase editors (e.g., ABE8) used in this invention can act on DNA, including single stranded DNA. Methods of using them to generate modifications in target nucleobase sequences in immune cells are presented. In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-methylated) strand opposite the targeted nucleobase. Mutation of the catalytic residue (e.g., D10 to A10) prevents cleavage of the edited strand containing the targeted A residue. Such Cas9 variants can generate a single-strand DNA break (nick) at a specific location based on the gRNA-defined target sequence, leading to repair of the non-edited strand, ultimately resulting in a nucleobase change on the non-edited strand.

Nucleobase Editor

Disclosed herein is a base editor or a nucleobase editor for editing, modifying or altering a target nucleotide sequence of a polynucleotide. Described herein is a nucleobase editor or a base editor comprising a polynucleotide programmable nucleotide binding domain and a nucleobase editing domain (e.g., adenosine deaminase). A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

Polynucleotide Programmable Nucleotide Binding Domain

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g., cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some embodiments, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g., DNA). In some embodiments, a nickase can be derived from a fully catalytically active (e.g., natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such embodiments, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g., natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

The amino acid sequence of an exemplary catalytically active Cas9 is as follows:

```
                                        (SEQ ID NO: 8)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD.
```

A base editor comprising a polynucleotide programmable nucleotide binding domain comprising a nickase domain is thus able to generate a single-strand DNA break (nick) at a specific polynucleotide target sequence (e.g., determined by the complementary sequence of a bound guide nucleic acid). In some embodiments, the strand of a nucleic acid duplex target polynucleotide sequence that is cleaved by a base editor comprising a nickase domain (e.g., Cas9-derived nickase domain) is the strand that is not edited by the base editor (i.e., the strand that is cleaved by the base editor is opposite to a strand comprising a base to be edited). In other embodiments, a base editor comprising a nickase domain (e.g., Cas9-derived nickase domain) can cleave the strand of a DNA molecule which is being targeted for editing. In such embodiments, the non-targeted strand is not cleaved.

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g., RuvC1 and/or HNH domains). In further embodiments, a catalytically dead polynucleotide programmable nucleotide binding domain comprises a point mutation (e.g., D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain). Additional suitable nuclease-inactive dCas9 domains can be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some embodiments, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein." Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3'-5' exonucleolytically. In nature, DNA-binding and cleavage typically requires protein and both RNAs. However, single guide RNAs ("sgRNA," or simply "gRNA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, a skilled artisan can change the genomic target of the Cas protein specificity is partially determined by how specific the gRNA targeting sequence is for the genomic target compared to the rest of the genome.

In some embodiments, the gRNA scaffold sequence is as follows: GUUUUAGAGC UAGAAAUAGC AAGUUAAAAU AAGGCUAGUC CGUUAUCAAC UUGAAAAAGU GGCACCGAGU CGGUGCUUUU (SEQ ID NO: 198).

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1, Cas12c/C2c3, Cas12d/CasY, Cas12e/CasX, Cas12g, Cas12h, and Cas12i, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., Cas9 from S. pyogenes). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., from S. pyogenes). Cas9 can refer to the wild-type or a modified form of the Cas9 protein that can comprise an amino acid change such as a deletion, insertion, substitution, variant, mutation, fusion, chimera, or any combination thereof.

In some embodiments, a CRISPR protein-derived domain of a base editor can include all or a portion of Cas9 from Corynebacterium ulcerans (NCBI Refs: NC_015683.1, NC_017317.1); Corynebacterium diphtheria (NCBI Refs: NC_016782.1, NC_016786.1); Spiroplasma syrphidicola (NCBI Ref: NC_021284.1); Prevotella intermedia (NCBI Ref: NC_017861.1); Spiroplasma taiwanense (NCBI Ref: NC_021846.1); Streptococcus iniae (NCBI Ref: NC_021314.1); Belliella baltica (NCBI Ref: NC_018010.1); Psychroflexus torquis (NCBI Ref: NC_018721.1); Streptococcus thermophilus (NCBI Ref: YP_820832.1); Listeria innocua (NCBI Ref: NP_472073.1); Campylobacter jejuni (NCBI Ref: YP_002344900.1); Neisseria meningitidis (NCBI Ref: YP_002342100.1), Streptococcus pyogenes, or Staphylococcus aureus.

Cas9 Domains of Nucleobase Editors

Cas9 nuclease sequences and structures are well known to those of skill in the art (See, e.g., "Complete genome sequence of an M1 strain of Streptococcus pyogenes." Ferretti et al., Proc. Natl. Acad. Sci. U.S.A. 98:4658-4663 (2001); "CRISPR RNA maturation by trans-encoded small RNA and host factor RNase III." Deltcheva E., et al., Nature 471:602-607(2011); and "A programmable dual-RNA-guided DNA endonuclease in adaptive bacterial immunity." Jinek M., et al., Science 337:816-821(2012), the entire contents of each of which are incorporated herein by reference). Cas9 orthologs have been described in various species, including, but not limited to, S. pyogenes and S.

153

*thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some embodiments, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain (dCas9), or a Cas9 nickase (nCas9). In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, Cas12b/C2C1, and Cas12c/C2C3.

In some embodiments, wild-type Cas9 corresponds to Cas9 from *Streptococcus pyogenes* (NCBI Reference Sequence: NC_017053.1, nucleotide and amino acid sequences as follows).

(SEQ ID NO: 23)
```
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC

TACTGATAAAGCGGATTTGCGCTTAATCTATTTGGCCTTAGCGCATATGATTAAGTTTCGTG
```

-continued

```
GTCATTTTTTGATTGAGGGAGATTTAAATCCTGATAATAGTGATGTGGACAAACTATTTATC

CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAAGA

TACTTACGATGATGATTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGATATTCAAAAAGCACAGGTGTCTGGACAAGGCCATAGITTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAAATCTAAATTAGTTTCTGACTTCCGAAAAGATTTCCAATTCT

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA
```

-continued

```
AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC

AAAAAGGAAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTGGAGCAGCA

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA
```

(SEQ ID NO: 22)

```
MDKKYSIGLDIGTNSVGWAVITDDYKVPSKKFKVLGNTDRHSIKKNLIGALLFGSGETAEAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQGHSLHEQIANLAGSPAIKKGILQTVKIV

DELVKVMGHKPENIVIEMARENQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR
```

-continued

EQAENIIHLFTLTNLGAPAAFKYFDTTIDRKRYTSTKEVLDATLIHQSITGLYETRIDLSQL

GGD (single underline: HNH domain; double underline: RuvC domain)

In some embodiments, wild-type Cas9 corresponds to, or comprises the following nucleotide and/or amino acid sequences:

(SEQ ID NO: 24)

ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAAGTACCCAACGATTTATCACCTCAGAAAAAAGCTAGTTGACTC

AACTGATAAAGCGGACCTGAGGTTAATCTACTTGGCTCTTGCCCATATGATAAAGTTCCGTG

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

GATCTCCGGGGTAGAAGATCGATTTAATGCGTCACTTGGTACGTATCATGACCTCCTAAAGA

TAATTAAAGATAAGGACTTCCTGGATAACGAAGAGAATGAAGATATCTTAGAAGATATAGTG

TTGACTCTTACCCTCTTTGAAGATCGGGAAATGATTGAGGAAAGACTAAAAACATACGCTCA

CCTGTTCGACGATAAGGTTATGAAACAGTTAAAGAGGCGTCGCTATACGGGCTGGGGACGAT

TGTCGCGGAAACITATCAACGGGATAAGAGACAAGCAAAGTGGTAAAACTATTCTCGATTTT

-continued

CTAAAGAGCGACGGCTTCGCCAATAGGAACTTTATGCAGCTGATCCATGATGACTCTTTAAC

CTTCAAAGAGGATATACAAAAGGCACAGGTTTCCGGACAAGGGGACTCATTGCACGAACATA

TTGCGAATCTTGCTGGTTCGCCAGCCATCAAAAAGGGCATACTCCAGACAGTCAAAGTAGTG

GATGAGCTAGTTAAGGTCATGGGACGTCACAAACCGGAAAACATTGTAATCGAGATGGCACG

CGAAAATCAAACGACTCAGAAGGGGCAAAAAAACAGTCGAGAGCGGATGAAGAGAATAGAAG

AGGGTATTAAAGAACTGGGCAGCCAGATCTTAAAGGAGCATCCTGTGGAAAATACCCAATTG

CAGAACGAGAAACTTTACCTCTATTACCTACAAAATGGAAGGGACATGTATGTTGATCAGGA

ACTGGACATAAACCGTTTATCTGATTACGACGTCGATCACATTGTACCCCAATCCTTTTTGA

AGGACGATTCAATCGACAATAAAGTGCTTACACGCTCGGATAAGAACCGAGGGAAAAGTGAC

AATGTTCCAAGCGAGGAAGTCGTAAAGAAAATGAAGAACTATTGGCGGCAGCTCCTAAATGC

GAAACTGATAACGCAAAGAAAGTTCGATAACTTAACTAAAGCTGAGAGGGGTGGCTTGTCTG

AACTTGACAAGGCCGGATTTATTAAACGTCAGCTCGTGGAAACCCGCCAAATCACAAAGCAT

GTTGCACAGATACTAGATTCCCGAATGAATACGAAATACGACGAGAACGATAAGCTGATTCG

GGAAGTCAAAGTAATCACTTTAAAGTCAAAATTGGTGTCGGACTTCAGAAAGGATTTTCAAT

TCTATAAAGTTAGGGAGATAAATAACTACCACCATGCGCACGACGCTTATCTTAATGCCGTC

GTAGGGACCGCACTCATTAAGAAATACCCGAAGCTAGAAAGTGAGTTTGTGTATGGTGATTA

CAAAGTTTATGACGTCCGTAAGATGATCGCGAAAAGCGAACAGGAGATAGGCAAGGCTACAG

CCAAATACTTCTTTTATTCTAACATTATGAATTTCTTTAAGACGGAAATCACTCTGGCAAAC

GGAGAGATACGCAAACGACCTTTAATTGAAACCAATGGGGAGACAGGTGAAATCGTATGGGA

TAAGGGCCGGGACTTCGCGACGGTGAGAAAAGTTTTGTCCATGCCCCAAGTCAACATAGTAA

AGAAAACTGAGGTGCAGACCGGAGGGTTTTCAAAGGAATCGATTCTTCCAAAAAGGAATAGT

GATAAGCTCATCGCTCGTAAAAAGGACTGGGACCCGAAAAAGTACGGTGGCTTCGATAGCCC

TACAGTTGCCTATTCTGTCCTAGTAGTGGCAAAAGTTGAGAAGGGAAAATCCAAGAAACTGA

AGTCAGTCAAAGAATTATTGGGGATAACGATTATGGAGCGCTCGTCTTTTGAAAAGAACCCC

ATCGACTTCCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGCCGGAGAGC

TTCAAAAGGGGAACGAACTCGCACTACCGTCTAAATACGTGAATTTCCTGTATTTAGCGTCC

CATTACGAGAAGTTGAAAGGTTCACCTGAAGATAACGAACAGAAGCAACTTTTTGTTGAGCA

GCACAAACATTATCTCGACGAAATCATAGAGCAAATTTCGGAATTCAGTAAGAGAGTCATCC

TAGCTGATGCCAATCTGGACAAAGTATTAAGCGCATACAACAAGCACAGGGATAAACCCATA

CGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAG

ACGCGACACTGATTCACCAATCCATCACGGGATTATATGAAACTCGGATAGATTTGTCACAG

CTTGGGGGTGACGGATCCCCCAAGAAGAAGAGGAAAGTCTCGAGCGACTACAAAGACCATGA

CGGTGATTATAAAGATCATGACATCGATTACAAGGATGACGATGACAAGGCTGCAGGA (SEQ ID NO: 25)

MDKK<u>YSIGLAIGTNSVGWAVITDEYKVPSKKFKVLGNTDRHSIKKNLIGALLFDSGETA</u>EAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

-continued

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQG<u>DSLHEHIANLAGSPAIKKGILQTVKVV</u>

<u>DELVKVMGRHKPENIVIEMAR</u>ENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERG<u>GLSELDKAGFIKRQLVETRQITKH</u>

<u>VAQILDSRMNTKYDENDKLIREVKVITLKSKLVSDFRKDFQFYKVREINNYHHAHDAYLNAV</u>

<u>VGTALIKKYPKLESEFVYGDYKVYDVRKMIAKSEQEIGKATAKYFFYSNIMNFFKTEITLAN</u>

<u>GEIRKRPLIETNGETGEIVWDKGRDFATVRKVLSMPQVNIVKKTEVQTGGFSKESILPKRNS</u>

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: HNH domain; double underline: RuvC domain).

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows):

(SEQ ID NO: 26)

ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAAATCTTATAGGGGCTCTTTTATTTGACAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

-continued

```
TATAAATTTATCAAACCAATTTTAGAAAAAATGGATGGTACTGAGGAATTATTGGTGAAACT

AAATCGTGAAGATTIGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAATGAAGATATCTTAGAGGATATTGTT

TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAATCCG

ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT
```

-continued

```
TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA
```

(SEQ ID NO: 8)
```
MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```
(single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

The amino acid sequence of an exemplary catalytically inactive Cas9 (dCas9) is as follows: MDKKYSIGLAIGTNSVGWAVITDEYKVPSKKFKVL-GNTDRHSIKKNLIGALLFDSGETAEAT RLKRTARR-RYTRRKNRICYLQEIFSNEMAKVDDSFFHRLEESFLV-EEDKKHERHPIFGNIVD EVAYHEKYPTIYHLRK-KLVDSTDKADLRLIYLALAHMIKFRGHFLIEGDLNP-DNSDVDKLFI QLVQTYNQLFEENPINASGVDAKAIL-SARLSKSRRLENLIAQLPGEKKNGLFGNLIALSLGL TPNFKSNFDLAEDAKLQLSKDTYDDDLDNLLAQI-GDQYADLFLAAKNLSDAILLSDILRVNT EITKAPL-SASMIKRYDEHHQDLTLLKALVRQQLPEKYKE-IFFDQSKNGYAGYIDGGASQEEF YKFIKPILEK-MDGTEELLVKLNREDLLRKQRTFDNGSIPHQIHLG-ELHAILRRQEDFYPFLK DNREKIEKILTFRIPYYVG-PLARGNSRFAWMTRKSEETITPWNFEEVVDKGAS-AQSFIERMT NFDKNLPNEKVLPKHSLLYEYFTVY-NELTKVKYVTEGMRKPAFLSGEQKKAIVDLLFKT-NRK VTVKQLKEDYFKKIECFDSVEISGVEDRF-NASLGTYHDLLKIIKDKDFLDNEENEDILEDIV LTL-TLFEDREMIEERLKTYAHLFDDKVMKQLKRRRYTG-WGRLSRKLINGIRDKQSGKTILDF LKSDGFAN-RNFMQLIHDDSLTFKEDIQKAQVSGQGDSLHEHIAN-LAGSPAIKKGILQTVKVV DELVKVMGRHKPENIVI-EMARENQTTQKGQKNSRERMKRIEEGIKEL-GSQILKEHPVENTQL QNEKLYLYYLQNGRDMYVDQ-ELDINRLSDYDVDAIVPQSFLKDDSIDNKVLTRSD-KNRGKSD NVPSEEVVKKMKNYWRQLLNAK-LITQRKFDNLTKAERGGLSELDKAGFIKRQLVE-TRQITKH VAQILDSRMNTKYDENDKLIREVKVITLK-SKLVSDFRKDFQFYKVREINNYHHAHDAYLNAV VGTALIKKYPKLESEFVYGDYKVYDVRKMIAKSE-QEIGKATAKYFFYSNIMNFFKTEITLAN GEIRKRPLI-ETNGETGEIVWDKGRDFATVRKVLSMPQVNIVKK-TEVQTGGFSKESILPKRNS DKLIARKKDWDPK-KYGGFDSPTVAYSVLVVAKVEKGKSKKLKSVKEL-LGITIMERSSFEKNP IDFLEAKGYKEVKKDLIIKLPK-YSLFELENGRKRMLASAGELQKGNELALPSKYVN-FLYLAS HYEKLKGSPEDNEQKQLFVEQHKHYL-DEIIEQISEFSKRVILADANLDKVLSAYNKHRDKPI REQAENIIHLFTLTNLGAPAAFKYFDTTIDRKRYT-STKEVLDATLIHQSITGLYETRIDLSQ LGGD (SEQ ID NO: 29) (see, e.g., Qi et al., "Repurposing CRISPR as an RNA-guided platform for sequence-specific control of gene expression." Cell. 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)).

In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9.

In some embodiments, the dCas9 comprises the amino acid sequence of dCas9 (D10A and H840A):

(SEQ ID NO: 29)

MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

-continued

```
EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```
(single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure. The amino acid sequence of an exemplary catalytically Cas9 nickase (nCas9) is as follows:

(SEQ ID NO: 25)
```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP
```

-continued

```
INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
```

In some embodiments, Cas9 refers to a Cas9 from archaea (e.g., nanoarchaea), which constitute a domain and kingdom of single-celled prokaryotic microbes. In some embodiments, the programmable nucleotide binding protein may be a CasX or CasY protein, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the programmable nucleotide binding protein is a naturally-occurring CasX or CasY protein. In some embodiments, the programmable nucleotide binding protein comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

An exemplary CasX ((uniprot: F0NN87; uniprot: F0NH53) tr|F0NN87|F0NN87_SULIHCRISPR-associated-Casx protein OS=*Sulfolobus islandicus* (strain HVE10/4) GN=SiH_0402 PE=4 SV=1) amino acid sequence is as follows:

```
                                        (SEQ ID NO: 34)
MEVPLYNIFGDNYIIQVATEAENSTIYNNKVEIDDEELRNVLNLAYKIAKN

NEDAAAERRGKAKKKKGEEGETTTSNIILPLSGNDKNPWTETLKCYNFPTT

VALSEVFKNFSQVKECEEVSAPSFVKPEFYEFGRSPGMVERTRRVKLEVEP

HYLIIAAAGWVLTRLGKAKVSEGDYVGVNVFTPTRGILYSLIQNVNGIVPG

IKPETAFGLWIARKVVSSVTNPNVSVVRIYTISDAVGQNPTTINGGFSIDL

TKLLEKRYLLSERLEAIARNALSISSNMRERYIVLANYIYEYLTG SKRLE

DLLYFANRDLIMNLNSDDGKVRDLKLISAYVNGELIRGEG.
```

An exemplary CasX (>tr|F0NH53|F0NH53_SULIR CRISPR associated protein, Casx OS=*Sulfolobus islandicus* (strain REY15A) GN=SiRe_0771 PE=4 SV=1) amino acid sequence is as follows:

```
                                        (SEQ ID NO: 35)
MEVPLYNIFGDNYIIQVATEAENSTIYNNKVEIDDEELRNVLNLAYKIAKN

NEDAAAERRGKAKKKKGEEGETTTSNIILPLSGNDKNPWTETLKCYNFPTT

VALSEVFKNFSQVKECEEVSAPSFVKPEFYKFGRSPGMVERTRRVKLEVEP

HYLIMAAAGWVLTRLGKAKVSEGDYVGVNVFTPTRGILYSLIQNVNGIVPG

IKPETAFGLWIARKVVSSVTNPNVSVVSIYTISDAVGQNPTTINGGFSIDL

TKLLEKRDLLSERLEAIARNALSISSNMRERYIVLANYIYEYLTGSKRLED

LLYFANRDLIMNLNSDDGKVRDLKLISAYVNGELIRGEG.
```

Deltaproteobacteria CasX

```
                                        (SEQ ID NO: 199)
MEKRINKIRKKLSADNATKPVSRSGPMKTLLVRVMTDDLKKRLEKRRKKPE

VMPQVISNNAANNLRMLLDDYTKMKEAILQVYWQEFKDDHVGLMCKFAQPA

SKKIDQNKLKPEMDEKGNLTTAGFACSQCGQPLFVYKLEQVSEKGKAYTNY

FGRCNVAEHEKLILLAQLKPVKDSDEAVTYSLGKFGQRALDFYSIHVTKES

THPVKPLAQIAGNRYASGPVGKALSDACMGTIASFLSKYQDIIIEHQKVVK
```

-continued

```
GNQKRLESLRELAGKENLEYPSVTLPPQPHTKEGVDfAYNEVIARVRMWVN

LNLWQKLKLSRDDAKPLLRLKGFPSFPVVERRENEVDWWNTINEVKKLIDA

KRDMGRVFWSGVTAEKRNTILEGYNYLPNENDHKKREGSLENPKKPAKRQF

GDLLLYLEKKYAGDWGKVFDEAWERIDKKIAGLTSHIEREEARNAEDAQSK

AVLTDWLRAKASFVLERLKEMDEKEFYACEIQLQKWYGDLRGNPFAVEAEN

RVVDISGFSIGSDGHSIQYRNLLAWKYLENGKREFYLLMNYGKKGRIRFTD

GTDIKKSGKWQGLLYGGGKAKVIDLTFDPDDEQLIILPLAFGTRQGREFIW

NDLLSLETGLIKLANGRVIEKTIYNKKIGRDEPALFVALTFERREVVDPSN

IKPVNLIGVARGENIPAVIALTDPEGCPLPEFKDSSGGPTDILRIGEGYKE

KQRAIQAAKEVEQRRAGGYSRKFASKSRNLADDMVRNSARDLFYHAVTHDA

VLVFANLSRGFGRQGKRTFMTERQYTKMEDWLTAKLAYEGLTSKTYLSKTL

AQYTSKTCSNCGFTITYADMDVMLVRLKKTSDGWATTLNNKELKAEYQITY

YNRYKRQTVEKELSAELDRLSEESGNNDISKWTKGRRDEALFLLKKRFSHR

PVQEQFVCLDCGHEVHAAEQAALNIARSWLFLNSNSTEFKSYKSGKQPFVG

AWQAFYKRRLKEVWKPNA
```

An exemplary CasY ((APG80656.1) >APG80656.1 CRISPR-associated protein CasY [uncultured Parcubacteria group bacterium]) amino acid sequence is as follows:

```
                                      (SEQ ID NO: 37)
MSKRHPRISGVKGYRLHAQRLEYTGKSGAMRTIKYPLYSSPSGGRTVPREI

VSAINDDYVGLYGLSNFDDLYNAEKRNEEKVYSVLDFWYDCVQYGAVFSYT

APGLLKNVAEVRGGSYELTKTLKGSHLYDELQIDKVIKFLNKKEISRANGS

LDKLKKDIIDCFKAEYRERHKDQCNKLADDIKNAKKDAGASLGERQKKLFR

DFFGISEQSENDKPSFTNPLNLTCCLLPFDTVNNNRNRGEVLFNKLKEYAQ

KLDKNEGSLEMWEYIGIGNSGTAFSNFLGEGFLGRLRENKITELKKAMMDI

TDAWRGQEQEEELEKRLRILAALTIKLREPKFDNHWGGYRSDINGKLSSWL

QNYINQTVKIKEDLKGHKKDLKKAKEMINRFGESDTKEEAVVSSLLESIEK

IVPDDSADDEKPDIPAIAIYRRFLSDGRLTLNRFVQREDVQEALIKERLEA

EKKKKPKKRKKKSDAEDEKETIDFKELFPHLAKPLKLVPNFYGDSKRELYK

KYKNAAIYTDALWKAVEKIYKSAFSSSLKNSFFDTDFDKDFFIKRLQKIFS

VYRRFNTDKWKPIVKNSFAPYCDIVSLAENEVLYKPKQSRSRKSAAIDKNR

VRLPSTENIAKAGIALARELSVAGFDWKDLLKKEEHEEYIDLIELHKTALA

LLLAVTETQLDISALDFVENGTVKDFMKTRDGNLVLEGRFLEMFSQSIVFS

ELRGLAGLMSRKEFITRSAIQTMNGKQAELLYIPHEFQSAKITTPKEMSRA

FLDLAPAEFATSLEPESLSEKSLLKLKQMRYYPHYFGYELTRTGQGIDGGV

AENALRLEKSPVKKREIKCKQYKTLGRGQNKIVLYVRSSYYQTQFLEWFLH

RPKNVQTDVAVSGSFLIDEKKVKTRWNYDALTVALEPVSGSERVFVSQPFT

IFPEKSAEEEGQRYLGIDIGEYGIAYTALEITGDSAKILDQNFISDPQLKT

LREEVKGLKLDQRRGTFAMPSTKIARIRESLVHSLRNRIHHLALKHKAKIV

YELEVSRFEEGKQKIKKVYATLKKADVYSEIDADKNLQTTVWGKLAVASEI

SASYTSQFCGACKKLWRAEMQVDETITTQELIGTVRVIKGGTLIDAIKDFM
```

-continued

```
RPPIFDENDTPFPKYRDFCDKHHISKKMRGNSCLFICPFCRANADADIQAS

QTIALLRYVKEEKKVEDYFERFRKLKNIKVLGQMKKI.
```

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some embodiments, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)](e.g., (b+c)/(a+b+c), where "a" is the band intensity of DNA substrate and "b" and "c" are the cleavage products).

In some embodiments, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., Cell. 2013 Sep. 12; 154(6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most embodiments, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag. In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some embodiments, Cas9 is a variant Cas9 protein. A variant Cas9 polypeptide has an amino acid sequence that is different by one amino acid (e.g., has a deletion, insertion, substitution, fusion) when compared to the amino acid sequence of a wild-type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some embodiments, the variant Cas9 protein has no substantial nuclease activity. When a subject Cas9 protein is a variant Cas9 protein that has no substantial nuclease activity, it can be referred to as "dCas9."

In some embodiments, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some embodiments, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some embodiments, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some embodiments, a variant Cas9 protein has a reduced ability to cleave both the complementary and the non-complementary strands of a double stranded target DNA. As a non-limiting example, in some embodiments, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some embodiments, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such embodiments, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' was used.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

In some embodiments, the Cas9 is a Cas9 variant having specificity for an altered PAM sequence. In some embodiments, the Additional Cas9 variants and PAM sequences are described in Miller, S. M., et al. Continuous evolution of SpCas9 variants compatible with non-G PAMs, Nat. Biotechnol. (2020), the entirety of which is incorporated herein by reference. in some embodiments, a Cas9 variate have no specific PAM requirements. In some embodiments, a Cas9 variant, e.g. a SpCas9 variant has specificity for a NRNH PAM, wherein R is A or G and H is A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 as numbered in SEQ ID NO: 1 or a corresponding position thereof. In some embodiments, the SpCas9 variant comprises an amino acid substitution at position 1114, 1135, 1218, 1219, 1221, 1249, 1320, 1321, 1323, 1332, 1333, 1335, or 1337 as numbered in SEQ ID NO: 1 or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 as numbered in SEQ ID NO: 1 or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 as numbered in SEQ ID NO: 1 or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 as numbered in SEQ ID NO: 1 or a corresponding position thereof. Exemplary amino acid substitutions and PAM specificity of SpCas9 variants are shown in Tables 3A-3D.

TABLE 3A

SpCas9 amino acid position

| SpCas9 | 1114 R | 1135 D | 1218 G | 1219 E | 1221 Q | 1249 P | 1320 A | 1321 P | 1323 A | 1332 D | 1333 R | 1335 R | 1337 T |
|---|---|---|---|---|---|---|---|---|---|---|---|---|
| AAA |  | N |  | V | H |  |  |  |  |  | G |  |  |
| AAA |  | N |  | V | H |  |  |  |  |  | G |  |  |
| AAA |  |  |  | V |  |  |  |  |  |  | G |  |  |
| TAA | G | N |  | V |  |  |  |  |  |  | I |  |  |
| TAA |  | N |  | V |  |  |  |  |  |  | I |  | A |
| TAA | G | N |  | V |  |  |  |  |  |  | I |  | A |
| CAA |  |  |  | V |  |  |  |  |  |  | K |  |  |
| CAA |  | N |  | V |  |  |  |  |  |  | K |  |  |
| CAA |  | N |  | V |  |  |  |  |  |  | K |  |  |
| GAA |  |  |  | V | H |  |  | V |  |  | K |  |  |
| GAA |  | N |  | V |  |  |  | V |  |  | K |  |  |
| GAA |  |  |  | V | H |  |  | V |  |  | K |  |  |
| TAT |  |  | S | V | H | S |  |  | S |  |  | L |  |
| TAT |  |  | S | V | H | S |  |  | S |  |  | L |  |
| TAT |  |  | S | V | H | S |  |  | S |  |  | L |  |
| GAT |  |  |  | V |  |  |  |  |  |  | I |  |  |
| GAT |  |  |  | V |  |  |  |  |  | D |  | Q |  |
| GAT |  |  |  | V |  |  |  |  |  | D |  | Q |  |
| CAC |  |  |  | V |  |  |  |  |  | N |  | Q | N |
| CAC |  | N |  | V |  |  |  |  |  |  |  | Q | N |
| CAC |  |  |  | V |  |  |  |  |  | N |  | Q | N |

TABLE 3B

SpCas9 amino acid position

| SpCas9 | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
|---|---|---|---|---|---|---|---|---|---|---|---|---|---|---|---|---|---|---|---|
| GAA |  |  |  |  |  |  |  |  |  | V | H |  |  |  |  |  | V |  | K |
| GAA |  |  | N | S |  |  |  |  |  | V |  |  |  |  |  |  | V | D | K |
| GAA |  |  | N |  |  |  |  |  |  | V | H |  | Y |  |  |  | V |  | K |
| CAA |  |  | N |  |  |  |  |  |  | V | H |  | Y |  |  |  | V |  | K |
| CAA | G |  | N | S |  |  |  |  |  | V | H |  | Y |  |  |  | V |  | K |
| CAA |  |  | N |  |  |  |  |  | R | V | H |  |  |  |  |  | V |  | K |
| CAA |  |  | N |  |  |  |  | G | R | V | H |  | Y |  |  |  | V |  | K |
| CAA |  |  | N |  |  |  |  |  |  | V | H |  | Y |  |  |  | V |  | K |
| AAA |  |  | N |  |  |  |  | G |  | V | H | R | Y |  |  |  | V | D | K |
| CAA | G |  | N |  |  |  |  | G |  | V | H |  | Y |  |  |  | V | D | K |
| CAA |  | L | N |  |  |  |  | G |  | V | H |  | Y |  |  | T | V | D | K |
| TAA | G |  | N |  |  |  |  | G |  | V | H |  | Y | G | S |  | V | D | K |
| TAA | G |  | N |  |  | E |  | G |  | V | H |  | Y |  | S |  | V |  | K |
| TAA | G |  | N |  |  |  |  | G |  | V | H |  | Y |  | S |  | V | D | K |
| TAA | G |  | N |  |  |  |  | G | R | V | H |  |  |  |  |  | V |  | K |
| TAA |  |  | N |  |  |  |  | G | R | V | H |  | Y |  |  |  | V |  | K |
| TAA | G |  | N | A |  |  |  | G |  | V | H |  |  |  |  |  | V |  | K |
| TAA | G |  | N |  |  |  |  |  |  | V | H |  |  |  |  |  | V |  | K |

TABLE 3C

SpCas9 amino acid position

| SpCas9 | 1114 R | 1131 Y | 1135 D | 1150 E | 1156 K | 1180 D | 1191 K | 1218 G | 1219 E | 1221 Q | 1227 A | 1249 P | 1253 E | 1286 N | 1293 A | 1320 A | 1321 P | 1332 D | 1335 R | 1339 T |
|---|---|---|---|---|---|---|---|---|---|---|---|---|---|---|---|---|---|---|---|---|
| SacB. TAT |  |  | N |  |  |  | N |  | V | H |  |  |  |  |  | V | S |  | L |  |
| SacB. TAT |  |  | N |  |  |  |  | S | V | H | S |  |  |  |  | S | G |  | L |  |
| AAT |  |  | N |  |  |  |  | S | V | H | V | S |  | K | T | S | G |  | L | I |
| TAT | G |  | N |  |  |  | G | S | V | H |  | S | K |  |  | S | G |  | L |  |
| TAT | G |  | N |  |  |  | G | S | V | H |  | S |  |  |  | S | G |  | L |  |
| TAT | G | C | N |  |  |  | G | S | V | H |  | S |  |  |  | S | G |  | L |  |
| TAT | G | C | N |  |  |  | G | S | V | H |  | S |  |  |  | S | G |  | L |  |

TABLE 3C-continued

| | 11 | 11 | 11 | 11 | 11 | 11 | 11 | 12 | 12 | 12 | 12 | 12 | 12 | 12 | 12 | 13 | 13 | 13 | 13 | 13 |
|---|---|---|---|---|---|---|---|---|---|---|---|---|---|---|---|---|---|---|---|---|
| | 14 | 31 | 35 | 50 | 56 | 80 | 91 | 18 | 19 | 21 | 27 | 49 | 53 | 86 | 93 | 20 | 21 | 32 | 35 | 39 |
| SpCas9 | R | Y | D | E | K | D | K | G | E | Q | A | P | E | N | A | A | P | D | R | T |
| TAT | G | C | N | | | G | | S | V | H | | S | | | | | S | G | L | |
| TAT | G | C | N | | E | G | | S | V | H | | S | | | | | S | G | L | |
| TAT | G | C | N | V | | G | | S | V | H | | S | | | | | S | G | L | |
| TAT | | C | N | | | G | | S | V | H | | S | | | | | S | G | L | |
| TAT | G | C | N | | | G | | S | V | H | | S | | | | | S | G | L | |

*SpCas9 amino acid position*

TABLE 3D

| | 111 | 112 | 113 | 118 | 120 | 121 | 123 | 128 | 130 | 133 | 133 | 133 | 133 | 134 |
|---|---|---|---|---|---|---|---|---|---|---|---|---|---|---|
| | 4 | 7 | 5 | 0 | 7 | 9 | 4 | 6 | 1 | 2 | 5 | 7 | 8 | 9 |
| SpCas9 | R | D | D | D | E | E | N | N | P | D | R | T | S | H |
| SacB.CAC | | | N | | V | | | | | N | Q | N | | |
| AAC | G | | N | | V | | | | | N | Q | N | | |
| AAC | G | | N | | V | | | | | N | Q | N | | |
| TAC | G | | N | | V | | | | | N | Q | N | | |
| TAC | G | | N | | V | | | | H | N | Q | N | | |
| TAC | G | | N | G | V | D | | | H | N | Q | N | | |
| TAC | G | | N | | V | | | | | N | Q | N | | |
| TAC | G | G | N | E | V | | | | H | N | Q | N | | |
| TAC | G | | N | | V | | | | H | N | Q | N | | |
| TAC | G | | N | | V | | | | | N | Q | N | T | R |

*SpCas9 amino acid position*

In some embodiments, the Cas9) is a *Neisseria menigitidis* Cas9 (NmeCas9) or a variant thereof. In some embodiments, the NmeCas9 has specificity for a NNNNGAYW PAM, wherein Y is C or T and W is A or T. In some embodiments, the NmeCas9 has specificity for a NNNNGYTT PAM, wherein Y is C or T. In some embodiments, the NmeCas9 has specificity for a NNNNGTCT PAM. In some embodiments, the NmeCas9 is a Nme1 Cas9. In some embodiments, the NmeCas9 has specificity for a NNNNGATT PAM, a NNNNCCTA PAM, a NNNNCCTC PAM, a NNNNCCTT PAM, a NNNNCCTG PAM, a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the Nme1Cas9 has specificity for a NNNNGATT PAM, a NNNNCCTA PAM, a NNNNCCTC PAM, a NNNNCCTT PAM, or a NNNNCCTG PAM. In some embodiments, the NmeCas9 has specificity for a CAA PAM, a CAAA PAM, or a CCA PAM. In some embodiments, the NmeCas9 is a Nme2 Cas9. In some embodiments, the NmeCas9 has specificity for a NNNNCC (N4CC) PAM, wherein N is any one of A, G, C, or T. in some embodiments, the NmeCas9 has specificity for a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the NmeCas9 is a Nme3Cas9. In some embodiments, the NmeCas9 has specificity for a NNNNCAAA PAM, a NNNNCC PAM, or a NNNNCNNN PAM. Additional Nme-Cas9 features and PAM sequences as described in Edraki et al. Mol. Cell. (2019) 73(4): 714-726 is incorporated herein by reference in its entirety.

An exemplary amino acid sequence of a Nme1Cas9 is provided below:

type II CRISPR RNA-guided endonuclease Cas9 [*Neisseria meningitidis*]WP 002235162.1

(SEQ ID NO: 27)
```
  1 maafkpnpin yilgldigia svgwamveid edenpiclid
    lgvrvferae vpktgdslam 61 arrlarsvrr ltrrrahrll rarrllkreg vlqaadfden
    glikslpntp wqlraaaldr 121 kltplewsav llhlikhrgy lsqrkneget adkelgallk
    gvadnahalq tgdfrtpael 181 alnkfekesg hirnqrgdys htfsrkdlqa elillfekqk
    efgnphvsgg lkegietllm 241 tqrpalsgda vqkmlghctf epaepkaakn tytaerfiwl
    tklnnlrile qgserpltdt 301 eratlmdepy rkskltyaqa rkllgledta ffkglrygkd
    naeastlmem kayhaisral 361 ekeglkdkks pinlspelqd eigtafslfk tdeditgrlk
    driqpeilea llkhisfdkf 421 vqislkalrr ivplmeqgkr ydeacaeiyg dhygkkntee
    kiylppipad eirnpvvlra 481 lsgarkving vvrrygspar ihietarevg ksfkdrkeie
    krqeenrkdr ekaaakfrey 541 fpnfvgepks kdilklrlye qqhgkclysg keinlgrine
    kgyveidhal pfsrtwddsf 601 nnkvlvlgse nqnkgnqtpy eyfngkdnsr ewqefkarve
    tsrfprskkq rillqkfded
```

-continued

```
661 gfkernlndt ryvnrflcqf vadrmrltgk gkkrvfasng
    qitnllrgfw glrkvraend 721 rhhaldavvv acstvamqqk itrfvrykem nafdgktidk
    etgevlhqkt hfpqpweffa 781 qevmirvfgk pdgkpefeea dtpeklrtll aeklssrpea
    vheyvtplfv srapnrkmsg 841 qghmetvksa krldegvsvl rvpltqlklk dlekmvnrer
    epklyealka rleahkddpa 901 kafaepfyky dkagnrtqqv kavrveqvqk tgvwvrnhng
    iadnatmvry dvfekgdkyy 961 lvpiyswqva kgilpdravv qgkdeedwql iddsfnfkfs
    lhpndlvevi tkkarmfgyf 1021 aschrgtgni nirihdldhk igkngilegi gvktalsfqk
     yqidelgkei rperlkkrpp 1081 vr
```

An exemplary amino acid sequence of a Nme2Cas9 is provided below:

type II CRISPR RNA-guided endonuclease Cas9 [*Neisseria meningitidis*]WP_002230835.1

```
                            (SEQ ID NO: 28)
   1 maafkpnpin yilgldigia svgwamveid eeenpirlid
     lgvrvferae vpktgdslam 61 arrlarsvrr ltrrrahrll rarrllkreg vlqaadfden
     glikslpntp wqlraaaldr 121 kltplewsav llhlikhrgy lsqrkneget adkelgallk
     gvannahalq tgdfrtpael 181 alnkfekesg hirnqrgdys htfsrkdlqa elillfekqk
     efgnphvsgg lkegietllm 241 tqrpalsgda vqkmlghctf epaepkaakn tytaerfiwl
     tklnnlrile qgserpltdt 301 eratlmdepy rkskltyaqa rkllgledta ffkglrygkd
     naeastlmem kayhaisral 361 ekeglkdkks pinlsselqd eigtafslfk tdeditgrlk
     drvqpeilea llkhisfdkf 421 vqislkalrr ivplmeqgkr ydeacaeiyg dhygkkntee
     kiylppipad eirnpvvlra 481 lsgarkving vvrrygspar ihietarevg ksfkdrkeie
     krqeenrkdr ekaaakfrey 541 fpnfvgepks kdilklrlye qqhgkclysg keinlvrine
     kgyveidhal pfsrtwddsf 601 nnkvlvlgse nqnkgnqtpy eyfngkdnsr ewqefkarve
     tsrfprskkq rillqkfded 661 gfkecnlndt ryvnrflcqf vadhilltgk gkrrvfasng
     qitnllrgfw glrkvraend 721 rhhaldavvv acstvamqqk itrfvrykem nafdgktidk
     etgkvlhqkt hfpqpweffa 781 qevmirvfgk pdgkpefeea dtpeklrtll aeklssrpea
     vheyvtplfv srapnrkmsg 841 ahkdtlrsak rfvkhnekis vkrvwlteik ladlenmvny
     kngreielye alkarleayg 901 gnakqafdpk dnpfykkggq lvkavrvekt qesgvllnkk
     naytiadngd mvrvdvfckv
```

-continued

```
 961 dkkgknqyfi vpiyawqvae nilpdidckg yriddsytfc
     fslhkydlia fqkdekskve 1021 fayyincdss ngrfylawhd kgskeqqfri stqnlvliqk
     yqvnelgkei rperlkkrpp 1081 vr
```

Cas12 Domains of Nucleobase Editors

Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors, albeit different types (Type II and Type V, respectively). In addition to Cpf1, Class 2, Type V CRISPR-Cas systems also comprise Cas12a/Cpf1, Cas12b/C2c1, Cas12c/C2c3, Cas12d/CasY, Cas12e/CasX, Cas12g, Cas12h, and Cas12i. See, e.g., Shmakov et al., "Discovery and Functional Characterization of Diverse Class 2 CRISPR Cas Systems," Mol. Cell, 2015 Nov. 5; 60(3): 385-397; Makarova et al., "Classification and Nomenclature of CRISPR-Cas Systems: Where from Here?" CRISPR Journal, 2018, 1(5): 325-336; and Yan et al., "Functionally Diverse Type V CRISPR-Cas Systems," Science, 2019 Jan. 4; 363: 88-91; the entire contents of each is hereby incorporated by reference. Type V Cas proteins contain a RuvC (or RuvC-like) endonuclease domain. While production of mature CRISPR RNA (crRNA) is generally tracrRNA-independent, Cas12b/C2c1, for example, requires tracrRNA for production of crRNA. Cas12b/C2cl depends on both crRNA and tracrRNA for DNA cleavage.

Nucleic acid programmable DNA binding proteins contemplated in the present invention include Cas proteins that are classified as Class 2, Type V (Cas12 proteins). Non-limiting examples of Cas Class 2, Type V proteins include Cas12a/Cpf1, Cas12b/C2c1, Cas12c/C2c3, Cas12d/CasY, Cas12e/CasX, Cas12g, Cas12h, and Cas12i, homologues thereof, or modified versions thereof. As used herein, a Cas12 protein can also be referred to as a Cas12 nuclease, a Cas12 domain, or a Cas12 protein domain. In some embodiments, the Cas12 proteins of the present invention comprise an amino acid sequence interrupted by an internally fused protein domain such as a deaminase domain.

In some embodiments, the Cas12 domain is a nuclease inactive Cas12 domain or a Cas12 nickase. In some embodiments, the Cas12 domain is a nuclease active domain. For example, the Cas12 domain may be a Cas12 domain that nicks one strand of a duplexed nucleic acid (e.g., duplexed DNA molecule). In some embodiments, the Cas12 domain comprises any one of the amino acid sequences as set forth herein. In some embodiments the Cas12 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas12 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas12 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas12 are provided. For example, in some embodiments, a protein comprises one of two Cas12 domains: (1) the gRNA binding domain of Cas12; or (2) the DNA cleavage domain of Cas12. In some embodiments, proteins comprising Cas12 or fragments thereof are referred to as "Cas12 variants." A Cas12 variant shares homology to Cas12, or a fragment thereof. For example, a Cas12 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas12. In some embodiments, the Cas12 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas12. In some embodiments, the Cas12 variant comprises a fragment of Cas12 (e.g., a gRNA binding domain or a DNA cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas12. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas12. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas12 corresponds to, or comprises in part or in whole, a Cas12 amino acid sequence having one or more mutations that alter the Cas12 nuclease activity. Such mutations, by way of example, include amino acid substitutions within the RuvC nuclease domain of Cas12. In some embodiments, variants or homologues of Cas12 are provided which are at least about 70% identical, at least about 80% identical, at least about 90% identical, at least about 95% identical, at least about 98% identical, at least about 99% identical, at least about 99.5% identical, or at least about 99.9% identical to a wild type Cas12. In some embodiments, variants of Cas12 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas12 fusion proteins as provided herein comprise the full-length amino acid sequence of a Cas12 protein, e.g., one of the Cas12 sequences provided herein. In other embodiments, however, fusion proteins as provided herein do not comprise a full-length Cas12 sequence, but only one or more fragments thereof. Exemplary amino acid sequences of suitable Cas12 domains are provided herein, and additional suitable sequences of Cas12 domains and fragments will be apparent to those of skill in the art.

Generally, the class 2, Type V Cas proteins have a single functional RuvC endonuclease domain (See, e.g., Chen et al., "CRISPR-Cas12a target binding unleashes indiscriminate single-stranded DNase activity," Science 360:436-439 (2018)). In some cases, the Cas12 protein is a variant Cas12b protein. (See Strecker et al., Nature Communications, 2019, 10(1): Art. No.: 212). In one embodiment, a variant Cas12 polypeptide has an amino acid sequence that is different by 1, 2, 3, 4, 5 or more amino acids (e.g., has a deletion, insertion, substitution, fusion) when compared to the amino acid sequence of a wild type Cas12 protein. In some instances, the variant Cas12 polypeptide has an amino acid change (e.g., deletion, insertion, or substitution) that reduces the activity of the Cas12 polypeptide. For example, in some instances, the variant Cas12 is a Cas12b polypeptide that has less than 50%, less than 40%, less than 30%, less than 20%, less than 10%, less than 5%, or less than 1% of the nickase activity of the corresponding wild-type Cas12b protein. In some cases, the variant Cas12b protein has no substantial nickase activity.

In some cases, a variant Cas12b protein has reduced nickase activity. For example, a variant Cas12b protein exhibits less than about 20%, less than about 15%, less than about 10%, less than about 5%, less than about 1%, or less than about 0.1%, of the nickase activity of a wild-type Cas12b protein.

In some embodiments, the Cas12 protein includes RNA-guided endonucleases from the Cas12a/Cpf1 family that displays activity in mammalian cells. CRISPR from *Prevotella* and *Francisella* 1 (CRISPR/Cpf1) is a DNA editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1, unlike Cas9, does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2, and Cas4 proteins more similar to types I and III than type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' or 5'-TTTN-3' in contrast to the G-rich PAM targeted by Cas9. After identification of PAM, Cpf1 introduces a sticky-end-like DNA double-stranded break having an overhang of 4 or 5 nucleotides.

In some aspects of the present invention, a vector encodes a CRISPR enzyme that is mutated to with respect to a corresponding wild-type enzyme such that the mutated CRISPR enzyme lacks the ability to cleave one or both strands of a target polynucleotide containing a target sequence can be used. Cas12 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., Cas12 from *Bacillus hisashii*). Cas12 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., from *Bacillus hisashii* (BhCas12b), *Bacillus* sp. V3-13 (BvCas12b), and *Alicyclobacillus acidiphilus* (AaCas12b)). Cas12 can refer to the wild type or a modified form of the Cas12 protein that can comprise an amino acid change such as a deletion, insertion, substitution, variant, mutation, fusion, chimera, or any combination thereof.

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and a deaminase domain. Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October; 1:325-336. doi: 10.1089/crispr.2018.0033; Yan et al., "Functionally diverse type V CRISPR-Cas systems" Science. 2019 Jan. 4; 363(6422):88-91. doi: 10.1126/science.aav7271, the entire contents of each are hereby incorporated by reference.

One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D908A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

Wild-type *Francisella novicida* Cpf1
(D917, E1006, and D1255 are bolded and underlined)
                                                    (SEQ ID NO: 200)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

*Francisella novicida* Cpf1 D917A
(A917, E1006, and D1255 are bolded and underlined)
                                                         (SEQ ID NO: 201)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

*Francisella novicida* Cpf1 E1006A
(D917, A1006, and D1255 are bolded and underlined)

(SEQ ID NO: 202)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

*Francisella novicida* Cpf1 D1255A
(D917, E1006, and A1255 are bolded and underlined)

(SEQ ID NO: 203)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

-continued

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN

*Francisella novicida* Cpf1 D917A/E1006A
(A917, A1006, and D1255 are bolded and underlined)

(SEQ ID NO: 204)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

*Francisella novicida* Cpf1 D917A/D1255A
(A917, E1006, and A1255 are bolded and underlined)

(SEQ ID NO: 205)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

```
LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
```

*Francisella novicida* Cpf1 E1006A/D1255A
(D917, A1006, and A1255 are bolded and underlined)

(SEQ ID NO: 206)

```
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
```

*Francisella novicida* Cpf1 D917A/E1006A/D1255A
(A917, A1006, and A1255 are bolded and underlined)

(SEQ ID NO: 207)

```
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ
```

-continued

```
INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
```

In some embodiments, one of the Cas9 domains present in the fusion protein may be replaced with a guide nucleotide sequence-programmable DNA-binding protein domain that has no requirements for a PAM sequence.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

Exemplary SaCas9 sequence (SEQ ID NO: 208)
```
KRNYILGLDIGITSVGYGIIDYETRDVIDAGVRLFKEANVENNEGRRSKRG

ARRLKRRRRHRIQRVKKLLFDYNLLTDHSELSGINPYEARVKGLSQKLSEE

EFSAALLHLAKRRGVHNVNEVEEDTGNELSTKEQISRNSKALEEKYVAELQ

LERLKKDGEVRGSINRFKTSDYVKEAKQLLKVQKAYHQLDQSFIDTYIDLL
```

-continued
```
ETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNE

EDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWH

TNDNQIAIFNRLKLVPKKVDLSQQKEIPTTLVDDFILSPVVKRSFIQSIKV

INAIIKKYGLPNDIIIELAREKNSKDAQKMINEMQKRNRQTNERIEEIIRT

TGKENAKYLIEKIKLHDMQEGKCLYSLEAIPLEDLLNNPFNYEVDHIIPRS

VSFDNSFNNKVLVKQEENSKKGNRTPFQYLSSSDSKISYETFKKHILNLAK

GKGRISKIKKEYLLEERDINRFSVQKDFINRNLVDTRYATRGLMNLLRSYF

RVNNLDVKVKSINGGFTSFLRRKWKFKKERNKGYKHHAEDALIIANADFIF

KEWKKLDKAKKVMENQMFEEKQAESMPEIETEQEYKEIFITPHQIKHIKDF

KDYKYSHRVDKKPNRELINDTLYSTRKDDKGNTLIVNNLNGLYDKDNDKLK

KLINKSPEKLLMYHHDPQTYQKLKLIMEQYGDEKNPLYKYYEETGNYLTKY

SKKDNGPVIKKIKYYGNKLNAHLDITDDYPNSRNKVVKLSLKPYRFDVYLD

NGVYKFVTVKNLDVIKKENYYEVNSKCYEEAKKLKKISNQAEFIASFYNND

IKINGELYRVIGVNNDLLNRIEVNMIDITYREYLENMNDKRPPRIIKTIAS

KTQSIKKYSTDILGNLYEVKSKKHPQIIKKG
```

Residue N579 above, which is underlined and in bold, may be mutated (e.g., to a A579) to yield a SaCas9 nickase.

Exemplary SaCas9n sequence (SEQ ID NO: 209)
```
KRNYILGLDIGITSVGYGIIDYETRDVIDAGVRLFKEANVENNEGRRSKRG

ARRLKRRRRHRIQRVKKLLFDYNLLTDHSELSGINPYEARVKGLSQKLSEE

EFSAALLHLAKRRGVHNVNEVEEDTGNELSTKEQISRNSKALEEKYVAELQ
```

-continued
LERLKKDGEVRGSINRFKTSDYVKEAKQLLKVQKAYHQLDQSFIDTYIDLL

ETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNE

EDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWH

TNDNQIAIFNRLKLVPKKVDLSQQKEIPTTLVDDFILSPVVKRSFIQSIKV

INAIIKKYGLPNDIIIELAREKNSKDAQKMINEMQKRNRQTNERIEEIIRT

TGKENAKYLIEKIKLHDMQEGKCLYSLEAIPLEDLLNNPFNYEVDHIIPRS

VSFDNSFNNKVLVKQEEASKKGNRTPFQYLSSSDSKISYETFKKHILNLAK

GKGRISKIKKEYLLEERDINRFSVQKDFINRNLVDTRYATRGLMNLLRSYF

RVNNLDVKVKSINGGFTSFLRRKWKFKKERNKGYKHHAEDALIIANADFIF

KEWKKLDKAKKVMENQMFEEKQAESMPEIETEQEYKEIFITPHQIKHIKDF

KDYKYSHRVDKKPNRELINDTLYSTRKDDKGNTLIVNNLNGLYDKDNDKLK

KLINKSPEKLLMYHHDPQTYQKLKLIMEQYGDEKNPLYKYYEETGNYLTKY

SKKDNGPVIKKIKYYGNKLNAHLDITDDYPNSRNKVVKLSLKPYRFDVYLD

NGVYKFVTVKNLDVIKKENYYEVNSKCYEEAKKLKKISNQAEFIASFYNND

LIKINGELYRVIGVNNDLLNRIEVNMIDITYREYLENMNDKRPPRIIKTIA

SKTQSIKKYSTDILGNLYEVKSKKHPQIIKKG

Residue A579 above, which can be mutated from N579 to yield a SaCas9 nickase, is underlined and in bold.

Exemplary SaKKH Cas9
(SEQ ID NO: 210)
KRNYILGLDIGITSVGYGIIDYETRDVIDAGVRLFKEANVENNEGRRSKRG

ARRLKRRRRHRIQRVKKLLFDYNLLTDHSELSGINPYEARVKGLSQKLSEE

EFSAALLHLAKRRGVHNVNEVEEDTGNELSTKEQISRNSKALEEKYVAELQ

-continued
LERLKKDGEVRGSINRFKTSDYVKEAKQLLKVQKAYHQLDQSFIDTYIDLL

ETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNE

EDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWH

TNDNQIAIFNRLKLVPKKVDLSQQKEIPTTLVDDFILSPVVKRSFIQSIKV

INAIIKKYGLPNDIIIELAREKNSKDAQKMINEMQKRNRQTNERIEEIIRT

TGKENAKYLIEKIKLHDMQEGKCLYSLEAIPLEDLLNNPFNYEVDHIIPRS

VSFDNSFNNKVLVKQEEASKKGNRTPFQYLSSSDSKISYETFKKHILNLAK

GKGRISKIKKEYLLEERDINRFSVQKDFINRNLVDTRYATRGLMNLLRSYF

RVNNLDVKVKSINGGFTSFLRRKWKFKKERNKGYKHHAEDALIIANADFIF

KEWKKLDKAKKVMENQMFEEKQAESMPEIETEQEYKEIFITPHQIKHIKDF

KDYKYSHRVDKKPNR*KL*INDTLYSTRKDDKGNTLIVNNLNGLYDKDNDKLK

KLINKSPEKLLMYHHDPQTYQKLKLIMEQYGDEKNPLYKYYEETGNYLTKY

SKKDNGPVIKKIKYYGNKLNAHLDITDDYPNSRNKVVKLSLKPYRFDVYLD

NGVYKFVTVKNLDVIKKENYYEVNSKCYEEAKKLKKISNQAEFIASFY*K*ND

LIKINGELYRVIGVNNDLLNRIEVNMIDITYREYLENMNDKRPP*H*IIKTIA

SKTQSIKKYSTDILGNLYEVKSKKHPQIIKKG.

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the napDNAbp is a circular permutant. In the following sequences, the plain text denotes an adenosine deaminase sequence, bold sequence indicates sequence derived from Cas9, the italicized sequence denotes a linker sequence, and the underlined sequence denotes a bipartite nuclear localization sequence, and double underlined sequence indicates mutations.

CP5 (with MSP "NGC" PID and "D10A" nickase):
(SEQ ID NO: 5)
EIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFMQPTVAYSVLVVAKVEK

GKSKKLKSVKELLGITIMERSSFEKNPIDFLEAKGYKEVKKDLIIKLPKYSLFELENGRKRM

LASAKFLQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPRAFKYFDTTIARKEYR

STKEVLDATLIHQSITGLYETRIDLSQLGGD_GGSGGSGGSGGSGGSGGSGGM_DKKYSIGLAI

GTNSVGWAVITDEYKVPSKKFKVLGNTDRHSIKKNLIGALLFDSGETAEATRLKRTARRRYT

RRKNRICYLQEIFSNEMAKVDDSFFHRLEESFLVEEDKKHERHPIFGNIVDEVAYHEKYPTI

YHLRKKLVDSTDKADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSLGLTPNFKSNFDLA

EDAKLQLSKDTYDDDLDNLLAQIGDQYADLFLAAKNLSDAILLSDILRVNTEITKAPLSASM

IKRYDEHHQDLTLLKALVRQQLPEKYKEIFFDQSKNGYAGYIDGGASQEEFYKFIKPILEKM

DGTEELLVKLNREDLLRKQRTFDNGSIPHQIHLGELHAILRRQEDFYPFLKDNREKIEKILT

-continued

```
FRIPYYVGPLARGNSRFAWMTRKSEETITPWNFEEVVDKGASAQSFIERMTNFDKNLPNEKV

LPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKVMGRHK

PENIVIEMARENQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSDNVPSEEVVKKM

KNYWRQLLNAKLITQRKFDNLTKAERGGLSELDKAGFIKRQLVETRQITKHVAQILDSRMNT

KYDENDKLIREVKVITLKSKLVSDFRKDFQFYKVREINNYHHAHDAYLNAVVGTALIKKYPK

LESEFVYGDYKVYDVRKMIAKSEQEGADKRTADGSEFESPKKKRKV*
```

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", Mol. Cell, 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system contains an effector with two predicated HEPN RNase domains. Production of mature CRISPR RNA is tracrRNA-independent, unlike production of CRISPR RNA by Cas12b/C2cl. Cas12b/C2c1 depends on both CRISPR RNA and tracrRNA for DNA cleavage.

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2cl bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2cl ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2cl protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2cl or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2cl or Cas12c/C2c3 from other bacterial species may also be used in accordance with the present disclosure.

A Cas12b/C2cl ((uniprot: TOD7A2 #2) sp|TOD7A2|C2C1_ALIAG CRISPR-associated endonuclease C2c1 OS=*Alicyclobacillus* acido-*terrestris* (strain ATCC 49025/DSM 3922/CIP 106132/NCIMB 13137/GD3B) GN=c2c1 PE=1 SV=1) amino acid sequence is as follows:

```
                                          (SEQ ID NO: 33)
MAVKSIKVKLRLDDMPEIRAGLWKLHKEVNAGVRYYTEWLSLLRQENLYRRSPNGDGEQECD

KTAEECKAELLERLRARQVENGHRGPAGSDDELLQLARQLYELLVPQAIGAKGDAQQIARKF

LSPLADKDAVGGLGIAKAGNKPRWVRMREAGEPGWEEEKEKAETRKSADRTADVLRALADFG

LKPLMRVYTDSEMSSVEWKPLRKGQAVRTWDRDMFQQAIERMMSWESWNQRVGQEYAKLVEQ

KNRFEQKNFVGQEHLVHLVNQLQQDMKEASPGLESKEQTAHYVTGRALRGSDKVFEKWGKLA

PDAPFDLYDAEIKNVQRRNTRRFGSHDLFAKLAEPEYQALWREDASFLTRYAVYNSILRKLN

HAKMFATFTLPDATAHPIWTRFDKLGGNLHQYTFLFNEFGERRHAIRFHKLLKVENGVAREV
```

DDVTVPISMSEQLDNLLPRDPNEPIALYFRDYGAEQHFTGEFGGAKIQCRRDQLAHMHRRRG

ARDVYLNVSVRVQSQSEARGERRPPYAAVFRLVGDNHRAFVHFDKLSDYLAEHPDDGKLGSE

GLLSGLRVMSVDLGLRTSASISVFRVARKDELKPNSKGRVPFFFPIKGNDNLVAVHERSQLL

KLPGETESKDLRAIREERQRTLRQLRTQLAYLRLLVRCGSEDVGRRERSWAKLIEQPVDAAN

HMTPDWREAFENELQKLKSLHGICSDKEWMDAVYESVRRVWRHMGKQVRDWRKDVRSGERPK

IRGYAKDVVGGNSIEQIEYLERQYKFLKSWSFFGKVSGQVIRAEKGSRFAITLREHIDHAKE

DRLKKLADRIIMEALGYVYALDERGKGKWVAKYPPCQLILLEELSEYQFNNDRPPSENNQLM

QWSHRGVFQELINQAQVHDLLVGTMYAAFSSRFDARTGAPGIRCRRVPARCTQEHNPEPFPW

WLNKFVVEHTLDACPLRADDLIPTGEGEIFVSPFSAEEGDFHQIHADLNAAQNLQQRLWSDF

DISQIRLRCDWGEVDGELVLIPRLTGKRTADSYSNKVFYTNTGVTYYERERGKKRRKVFAQE

KLSEEEAELLVEADEAREKSVVLMRDPSGIINRGNWTRQKEFWSMVNQRIEGYLVKQIRSR

VPLQDSACENTGDI

AacCas12b (*Alicyclobacillus acidiphdus*) - WP_067623834

(SEQ ID NO: 211)

MAVKSMKVKLRLDNMPEIRAGLWKLHTEVNAGVRYYTEWLSLLRQENLYRRSPNGDGEQECY

KTAEECKAELLERLRARQVENGHCGPAGSDDELLQLARQLYELLVPQAIGAKGDAQQIARKF

LSPLADKDAVGGLGIAKAGNKPRWVRMREAGEPGWEEEKAKAEARKSTDRTADVLRALADFG

LKPLMRVYTDSDMSSVQWKPLRKGQAVRTWDRDMFQQAIERMMSWESWNQRVGEAYAKLVEQ

KSRFEQKNFVGQEHLVQLVNQLQQDMKEASHGLESKEQTAHYLTGRALRGSDKVFEKWEKLD

PDAPFDLYDTEIKNVQRRNTRRFGSHDLFAKLAEPKYQALWREDASFLTRYAVYNSIVRKLN

HAKMFATFTLPDATAHPIWTRFDKLGGNLHQYTFLFNEFGEGRHAIRFQKLLTVEDGVAKEV

DDVTVPISMSAQLDDLLPRDPHELVALYFQDYGAEQHLAGEFGGAKIQYRRDQLNHLHARRG

ARDVYLNLSVRVQSQSEARGERRPPYAAVFRLVGDNHRAFVHFDKLSDYLAEHPDDGKLGSE

GLLSGLRVMSVDLGLRTSASISVFRVARKDELKPNSEGRVPFCFPIEGNENLVAVHERSQLL

KLPGETESKDLRAIREERQRTLRQLRTQLAYLRLLVRCGSEDVGRRERSWAKLIEQPMDANQ

MTPDWREAFEDELQKLKSLYGICGDREWTEAVYESVRRVWRHMGKQVRDWRKDVRSGERPKI

RGYQKDVVGGNSIEQIEYLERQYKFLKSWSFFGKVSGQVIRAEKGSRFAITLREHIDHAKED

RLKKLADRIIMEALGYVYALDDERGKGKWVAKYPPCQLILLEELSEYQFNNDRPPSENNQLM

QWSHRGVFQELLNQAQVHDLLVGTMYAAFSSRFDARTGAPGIRCRRVPARCAREQNPEPFPW

WLNKFVAEHKLDGCPLRADDLIPTGEGEFFVSPFSAEEGDFHQIHADLNAAQNLQRRLWSDF

DISQIRLRCDWGEVDGEPVLIPRTTGKRTADSYGNKVFYTKTGVTYYERERGKKRRKVFAQE

ELSEEEAELLVEADEAREKSVVLMRDPSGIINRGDWTRQKEFWSMVNQRIEGYLVKQIRSRV

RLQESACENTGDI

BhCas12b (*Bacillus hisashii*) NCBI Reference Sequence: WP_095142515

(SEQ ID NO: 38)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDENEPSEKYLEVFKDYQRKHPREAGDYSVYEFLSKKENHFIWRNHPEYPY

LYATFCEIDKKKKDAKQQATFTLADPINHPLWVRFEERSGSNLNKYRILTEQLHTEKLKKKL

-continued

TVQLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKVVNFKP

KELTEWIKDSKGKKLKSGIESLEIGLRVMSIDLGQRQAAAASIFEVVDQKPDIEGKLFFPIK

GTELYAVHRASFNIKLPGETLVKSREVLRKAREDNLKLMNQKLNFLRNVLHFQQFEDITERE

KRVTKWISRQENSDVPLVYQDELIQIRELMYKPYKDWVAFLKQLHKRLEVEIGKEVKHWRKS

LSDGRKGLYGISLKNIDEIDRTRKFLLRWSLRPTEPGEVRRLEPGQRFAIDQLNHLNALKED

RLKKMANTIIMHALGYCYDVRKKKWQAKNPACQIILFEDLSNYNPYEERSRFENSKLMKWSR

REIPRQVALQGEIYGLQVGEVGAQFSSRFHAKTGSPGIRCSVVTKEKLQDNRFFKNLQREGR

LTLDKIAVLKEGDLYPDKGGEKFISLSKDRKCVTTHADINAAQNLQKRFWTRTHGFYKVYCK

AYQVDGQTVYIPESKDQKQKIIEEFGEGYFILKDGVYEWVNAGKLKIKKGSSKQSSSELVDS

DILKDSFDLASELKGEKLMLYRDPSGNVFPSDKWMAAGVFFGKLERILISKLTNQYSISTIE

DDSSKQSMKRPAATKKAGQAKKKK

Including the variant termed BvCas12b V4 (S893R/K846R/E837G changes rel. to wt above). BhCas12b (V4) is expressed as follows: 5′ mRNA Cap---5′UTR---bhCas12b---STOP sequence --- 3′UTR --- 120polyA tail ("120polyA" disclosed as SEQ ID NO: 212)

5′ UTR:
(SEQ ID NO: 213)
GGGAAATAAGAGAGAAAAGAAGAGTAAGAAGAAATATAAGAGCCACC

3′ UTR (TriLink standard UTR)
(SEQ ID NO: 214)
GCTGGAGCCTCGGTGGCCATGCTTCTTGCCCCTTGGGCCTCCCCCCAGCCCCTCCTCCCCTT

CCTGCACCCGTACCCCCGTGGTCTTTGAATAAAGTCTGA

Nucleic acid sequence of bhCas12b (V4)
(SEQ ID NO: 215)
ATGGCCCCAAAGAAGAAGCGGAAGGTCGGTATCCACGGAGTCCCAGCAGCCGCCACCAGATC

CTTCATCCTGAAGATCGAGCCCAACGAGGAAGTGAAGAAAGGCCTCTGGAAAACCCACGAGG

TGCTGAACCACGGAATCGCCTACTACATGAATATCCTGAAGCTGATCCGGCAAGAGGCCATC

TACGAGCACCACGAGCAGGACCCCAAGAATCCCAAGAAGGTGTCCAAGGCCGAGATCCAGGC

CGAGCTGTGGGATTTCGTGCTGAAGATGCAGAAGTGCAACAGCTTCACACACGAGGTGGACA

AGGACGAGGTGTTCAACATCCTGAGAGAGCTGTACGAGGAACTGGTGCCCAGCAGCGTGGAA

AAGAAGGGCGAAGCCAACCAGCTGAGCAACAAGTTTCTGTACCCTCTGGTGGACCCCAACAG

CCAGTCTGGAAAGGGAACAGCCAGCAGCGGCAGAAAGCCCAGATGGTACAACCTGAAGATTG

CCGGCGATCCCTCCTGGGAAGAAGAGAAGAAGAAGTGGGAAGAAGATAAGAAAAAGGACCCG

CTGGCCAAGATCCTGGGCAAGCTGGCTGAGTACGGACTGATCCCTCTGTTCATCCCCTACAC

CGACAGCAACGAGCCCATCGTGAAAGAAATCAAGTGGATGGAAAAGTCCCGGAACCAGAGCG

TGCGGCGGCTGGATAAGGACATGTTCATTCAGGCCCTGGAACGGTTCCTGAGCTGGGAGAGC

TGGAACCTGAAAGTGAAAGAGGAATACGAGAAGGTCGAGAAAGAGTACAAGACCCTGGAAGA

GAGGATCAAAGAGGACATCCAGGCTCTGAAGGCTCTGGAACAGTATGAGAAAGAGCGGCAAG

AACAGCTGCTGCGGGACACCCTGAACACCAACGAGTACCGGCTGAGCAAGAGAGGCCTTAGA

GGCTGGCGGGAAATCATCCAGAAATGGCTGAAAATGGACGAGAACGAGCCCTCCGAGAAGTA

CCTGGAAGTGTTCAAGGACTACCAGCGGAAGCACCCTAGAGAGGCCGGCGATTACAGCGTGT

ACGAGTTCCTGTCCAAGAAAGAGAACCACTTCATCTGGCGGAATCACCCTGAGTACCCCTAC

-continued

```
CTGTACGCCACCTTCTGCGAGATCGACAAGAAAAGAAGGACGCCAAGCAGCAGGCCACCTT

CACACTGGCCGATCCTATCAATCACCCTCTGTGGGTCCGATTCGAGGAAAGAAGCGGCAGCA

ACCTGAACAAGTACAGAATCCTGACCGAGCAGCTGCACACCGAGAAGCTGAAGAAAAAGCTG

ACAGTGCAGCTGGACCGGCTGATCTACCCTACAGAATCTGGCGGCTGGGAAGAGAAGGGCAA

AGTGGACATTGTGCTGCTGCCCAGCCGGCAGTTCTACAACCAGATCTTCCTGGACATCGAGG

AAAAGGGCAAGCACGCCTTCACCTACAAGGATGAGAGCATCAAGTTCCCTCTGAAGGGCACA

CTCGGCGGAGCCAGAGTGCAGTTCGACAGAGATCACCTGAGAAGATACCCTCACAAGGTGGA

AAGCGGCAACGTGGGCAGAATCTACTTCAACATGACCGTGAACATCGAGCCTACAGAGTCCC

CAGTGTCCAAGTCTCTGAAGATCCACCGGGACGACTTCCCCAAGGTGGTCAACTTCAAGCCC

AAAGAACTGACCGAGTGGATCAAGGACAGCAAGGGCAAGAAACTGAAGTCCGGCATCGAGTC

CCTGGAAATCGGCCTGAGAGTGATGAGCATCGACCTGGGACAGAGACAGGCCGCTGCCGCCT

CTATTTTCGAGGTGGTGGATCAGAAGCCCGACATCGAAGGCAAGCTGTTTTTCCCAATCAAG

GGCACCGAGCTGTATGCCGTGCACAGAGCCAGCTTCAACATCAAGCTGCCCGGCGAGACACT

GGTCAAGAGCAGAGAAGTGCTGCGGAAGGCCAGAGAGGACAATCTGAAACTGATGAACCAGA

AGCTCAACTTCCTGCGGAACGTGCTGCACTTCCAGCAGTTCGAGGACATCACCGAGAGAGAG

AAGCGGGTCACCAAGTGGATCAGCAGACAAGAGAACAGCGACGTGCCCCTGGTGTACCAGGA

TGAGCTGATCCAGATCCGCGAGCTGATGTACAAGCCTTACAAGGACTGGGTCGCCTTCCTGA

AGCAGCTCCACAAGAGACTGGAAGTCGAGATCGGCAAAGAAGTGAAGCACTGGCGGAAGTCC

CTGAGCGACGGAAGAAAGGGCCTGTACGGCATCTCCCTGAAGAACATCGACGAGATCGATCG

GACCCGGAAGTTCCTGCTGAGATGGTCCCTGAGGCCTACCGAACCTGGCGAAGTGCGTAGAC

TGGAACCCGGCCAGAGATTCGCCATCGACCAGCTGAATCACCTGAACGCCCTGAAAGAAGAT

CGGCTGAAGAAGATGGCCAACACCATCATCATGCACGCCCTGGGCTACTGCTACGACGTGCG

GAAGAAGAAATGGCAGGCTAAGAACCCCGCCTGCCAGATCATCCTGTTCGAGGATCTGAGCA

ACTACAACCCCTACGAGGAAAGGTCCCGCTTCGAGAACAGCAAGCTCATGAAGTGGTCCAGA

CGCGAGATCCCCAGACAGGTTGCACTGCAGGGCGAGATCTATGGCCTGCAAGTGGGAGAAGT

GGGCGCTCAGTTCAGCAGCAGATTCCACGCCAAGACAGGCAGCCCTGGCATCAGATGTAGCG

TCGTGACCAAAGAGAAGCTGCAGGACAATCGGTTCTTCAAGAATCTGCAGAGAGAGGGCAGA

CTGACCCTGGACAAAATCGCCGTGCTGAAAGAGGGCGATCTGTACCCAGACAAAGGCGGCGA

GAAGTTCATCAGCCTGAGCAAGGATCGGAAGTGCGTGACCACACACGCCGACATCAACGCCG

CTCAGAACCTGCAGAAGCGGTTCTGGACAAGAACCCACGGCTTCTACAAGGTGTACTGCAAG

GCCTACCAGGTGGACGGCCAGACCGTGTACATCCCTGAGAGCAAGGACCAGAAGCAGAAGAT

CATCGAAGAGTTCGGCGAGGGCTACTTCATTCTGAAGGACGGGGTGTACGAATGGGTCAACG

CCGGCAAGCTGAAAATCAAGAAGGGCAGCTCCAAGCAGAGCAGCAGCGAGCTGGTGGATAGC

GACATCCTGAAAGACAGCTTCGACCTGGCCTCCGAGCTGAAAGGCGAAAAGCTGATGCTGTA

CAGGGACCCCAGCGGCAATGTGTTCCCCAGCGACAAATGGATGGCCGCTGGCGTGTTCTTCG

GAAAGCTGGAACGCATCCTGATCAGCAAGCTGACCAACCAGTACTCCATCAGCACCATCGAG

GACGACAGCAGCAAGCAGTCTATGAAAAGGCCGGCGGCCACGAAAAAGGCCGGCCAGGCAAA

AAAGAAAAAG
```

In some embodiments, the Cas12b is BvCas12B. In some embodiments, the Cas12b comprises amino acid substitutions S893R, K846R, and E837G as numbered in BvCas12B exemplary sequence provided below.

```
BvCas12b (Bacillus sp. V3-13) NCBI Reference
Sequence: WP_101661451.1
                              (SEQ ID NO: 216)
MAIRSIKLKMKTNSGTDSIYLRKALWRTHQLINEGIAYYMNLLTLYRQEAI

GDKTKEAYQAELINIIRNQQRNNGSSEEHGSDQEILALLRQLYELIIPSSI

GESGDANQLGNKFLYPLVDPNSQSGKGTSNAGRKPRWKRLKEEGNPDWELE

KKKDEERKAKDPTVKIFDNLNKYGLLPLFPLFTNIQKDIEWLPLGKRQSVR

KWDKDMFIQAIERLLSWESWNRRVADEYKQLKEKTESYYKEHLTGGEEWIE

KIRKFEKERNMELEKNAFAPNDGYFITSRQIRGWDRVYEKWSKLPESASPE

ELWKVVAEQQNKMSEGFGDPKVFSFLANRENRDIWRGHSERIYHIAAYNGL

QKKLSRTKEQATFTLPDAIEHPLWIRYESPGGTNLNLFKLEEKQKKNYYVT

LSKIIWPSEEKWIEKENIEIPLAPSIQFNRQIKLKQHVKGKQEISFSDYSS

RISLDGVLGGSRIQFNRKYIKNHKELLGEGDIGPVFFNLVVDVAPLQETRN

GRLQSPIGKALKVISSDFSKVIDYKPKELMDWMNTGSASNSFGVASLLEGM

RVMSIDMGQRTSASVSIFEVVKELPKDQEQKLFYSINDTELFAIHKRSFLL

NLPGEVVTKNNKQQRQERRKKRQFVRSQIRMLANVLRLETKKTPDERKKAI

HKLMEIVQSYDSWTASQKEVWEKELNLLTNMAAFNDEIWKESLVELHHRIE

PYVGQIVSKWRKGLSEGRKNLAGISMWNIDELEDTRRLLISWSKRSRTPGE

ANRIETDEPFGSSLLQHIQNVKDDRLKQMANLIIMTALGFKYDKEEKDRYK

RWKETYPACQIILFENLNRYLFNLDRSRRENSRLMKWAHRSIPRTVSMQGE

MFGLQVGDVRSEYSSRFHAKTGAPGIRCHALTEEDLKAGSNTLKRLIEDGF

INESELAYLKKGDIIPSQGGELFVTLSKRYKKDSDNNELTVIHADINAAQN

LQKRFWQQNSEVYRVPCQLARMGEDKLYIPKSQTETIKKYFGKGSFVKNNT

EQEVYKWEKSEKMKIKTDTTFDLQDLDGFEDISKTIELAQEQQKKYLTMFR

DPSGYFFNNETWRPQKEYWSIVNNIIKSCLKKKILSNKVEL
```

In some embodiments, the Cas12b is BTCas12b.BTCas12b (Bacillus thermoamylovorans) NCBI Reference Sequence: WP_041902512

```
                              (SEQ ID NO: 217)
MATRSFILKIEPNEEVKKGLWKTHEVLNHGIAYYMNILKLIRQEAIYEHHE

QDPKNPKKVSKAEIQAELWDFVLKMQKCNSFTHEVDKDVVFNILRELYEEL

VPSSVEKKGEANQLSNKFLYPLVDPNSQSGKGTASSGRKPRWYNLKIAGDP

SWEEEKKKWEEDKKKDPLAKILGKLAEYGLIPLFIPFTDSNEPIVKEIKWM

EKSRNQSVRRLDKDMFIQALERFLSWESWNLKVKEEYEKVEKEHKTLEERI

KEDIQAFKSLEQYEKERQEQLLRDTLNTNEYRLSKRGLRGWREIIQKWLKM

DENEPSEKYLEVFKDYQRKHPREAGDYSVYEFLSKKENHFIWRNHPEYPYL

YATFCEIDKKKKDAKQQATFTLADPINHPLWVRFEERSGSNLNKYRILTEQ

LHTEKLKKKLTVQLDRLIYPTESGGWEEKGKVDIVLLPSRQFYNQIFLDIE

EKGKHAFTYKDESIKFPLKGTLGGARVQFDRDHLRRYPHKVESGNVGRIYF

NMTVNIEPTESPVSKSLKIHRDDFPKFVNFKPKELTEWIKDSKGKKLKSGI
```

-continued

```
ESLEIGLRVMSIDLGQRQAAAASIFEVVDQKPDIEGKLFFPIKGTELYAVH

RASFNIKLPGETLVKSREVLRKAREDNLKLMNQKLNFLRNVLHFQQFEDIT

EREKRVTKWISRQENSDVPLVYQDELIQIRELMYKPYKDWVAFLKQLHKRL

EVEIGKEVKHWRKSLSDGRKGLYGISLKNIDEIDRTRKFLLRWSLRPTEPG

EVRRLEPGQRFAIDQLNHLNALKEDRLKKMANTIIMHALGYCYDVRKKKWQ

AKNPACQIILFEDLSNYNPYEERSRFENSKLMKWSRREIPRQVALQGEIYG

LQVGEVGAQFSSRFHAKTGSPGIRCSVVTKEKLQDNRFFKNLQREGRLTLD

KIAVLKEGDLYPDKGGEKFISLSKDRKLVTTHADINAAQNLQKRFWTRTHG

FYKVYCKAYQVDGQTVYIPESKDQKQKIIEEFGEGYFILKDGVYEWGNAGK

LKIKKGSSKQSSSELVDSDILKDSFDLASELKGEKLMLYRDPSGNVFPSDK

WMAAGVFFGKLERILISKLTNQYSISTIEDDSSKQSM
```

In some embodiments, a napDNAbp refers to Cas12c. In some embodiments, the Cas12c protein is a Cas12cl or a variant of Cas12cl. In some embodiments, the Cas12 protein is a Cas12c2 or a variant of Cas12c2. In some embodiments, the Cas12 protein is a Cas12c protein from *Oleiphilus* sp. H10009 (i.e., OspCas12c) or a variant of OspCas12c. These Cas12c molecules have been described in Yan et al., "Functionally Diverse Type V CRISPR-Cas Systems," Science, 2019 Jan. 4; 363: 88-91; the entire contents of which is hereby incorporated by reference. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12cl, Cas12c2, or OspCas12c protein. In some embodiments, the napDNAbp is a naturally-occurring Cas12cl, Cas12c2, or OspCas12c protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12cl, Cas12c2, or OspCas12c protein described herein. It should be appreciated that Cas12cl, Cas12c2, or OspCas12c from other bacterial species may also be used in accordance with the present disclosure.

```
Cas12cl
                              (SEQ ID NO: 218)
MQTKKTHLHLISAKASRKYRRTIACLSDTAKKDLERRKQSGAADPAQELSC

LKTIKFKLEVPEGSKLPSFDRISQIYNALETIEKGSLSYLLFALILSGFRI

FPNSSAAKTFASSSCYKNDQFASQIKEIFGEMVKNFIPSELESILKKGRRK

NNKDWTEENIKRVLNSEFGRKNSEGSSALFDSFLSKFSQELFRKFDSWNEV

NKKYLEAAELLDSMLASYGPFDSVCKMIGDSDSRNSLPDKSTIAFTNNAEI

TVDIESSVMPYMAIAALLREYRQSKSKAAPVAYVQSHLTTINGNGLSWFFK

FGLDLIRKAPVSSKQSTSDGSKSLQELFSVPDDKLDGLKFIKEACEALPEA

SLLCGEKGELLGYQDFRTSFAGHIDSWVANYVNRLFELIELVNQLPESIKL

PSILTQKNHNLVASLGLQEAEVSHSLELFEGLVKNVRQTLKKLAGIDISSS

PNEQDIKEFYAFSDVLNRLGSIRNQIENAVQTAKKDKIDLESAIEWKEWKK

LKKLPKLNGLGGGVPKQQELLDKALESVKQIRHYQRIDFERVIQWAVNEHC
```

-continued

LETVPKFLVDAEKKKINKESSTDFAAKENAVRFLLEGIGAAARGKTDSVSK

AAYNWFVVNNFLAKKDLNRYFINCQGCIYKPPYSKRRSLAFALRSDNKDTI

EVVWEKFETFYKEISKEIEKFNIFSQEFQTFLHLENLRMKLLLRRIQKPIP

AEIAFFSLPQEYYDSLPPNVAFLALNQEITPSEYITQFNLYSSFLNGNLIL

LRRSRSYLRAKFSWVGNSKLIYAAKEARLWKIPNAYWKSDEWKMILDSNVL

VFDKAGNVLPAPTLKKVCEREGDLRLFYPLLRQLPHDWCYRNPFVKSVGRE

KNVIEVNKEGEPKVASALPGSLFRLIGPAPFKSLLDDCFFNPLDKDLRECM

LIVDQEISQKVEAQKVEASLESCTYSIAVPIRYHLEEPKVSNQFENVLAID

QGEAGLAYAVFSLKSIGEAETKPIAVGTIRIPSIRRLIHSVSTYRKKKQRL

QNFKQNYDSTAFIMRENVTGDVCAKIVGLMKEFNAFPVLEYDVKNLESGSR

QLSAVYKAVNSHFLYFKEPGRDALRKQLWYGGDSWTIDGIEIVTRERKEDG

KEGVEKIVPLKVFPGRSVSARFTSKTCSCCGRNVFDWLFTEKKAKTNKKFN

VNSKGELTTADGVIQLFEADRSKGPKFYARRKERTPLTKPIAKGSYSLEEI

ERRVRTNLRRAPKSKQSRDTSQSQYFCVYKDCALHFSGMQADENAAINIGR

RFLTALRKNRRSDFPSNVKISDRLLDN

Cas12c2

(SEQ ID NO: 219)
MTKHSIPLHAFRNSGADARKWKGRIALLAKRGKETMRTLQFPLEMSEPEAA

AINTTPFAVAYNAIEGTGKGTLFDYWAKLHLAGFRFFPSGGAATIFRQQAV

FEDASWNAAFCQQSGKDWPWLVPSKLYERFTKAPREVAKKDGSKKSIEFTQ

ENVANESHVSLVGASITDKTPEDQKEFFLKMAGALAEKFDSWKSANEDRIV

AMKVIDEFLKSEGLHLPSLENIAVKCSVETKPDNATVAWHDAPMSGVQNLA

IGVFATCASRIDNIYDLNGGKLSKLIQESATTPNVTALSWLFGKGLEYFRT

TDIDTIMQDFNIPASAKESIKPLVESAQAIPTMTVLGKKNYAPFRPNFGGK

IDSWIANYASRLMLLNDILEQIEPGFELPQALLDNETLMSGIDMTGDELKE

LIEAVYAWVDAAKQGLATLLGRGGNVDDAVQTFEQFSAMMDTLNGTLNTIS

ARYVRAVEMAGKDEARLEKLIECKFDIPKWCKSVPKLVGISGGLPKVEEEI

KVMNAAFKDVRARMFVRFEEIAAYVASKGAGMDVYDALEKRELEQIKKLKS

AVPERAHIQAYRAVLHRIGRAVQNCSEKTKQLFSSKVIEMGVFKNPSHLNN

FIFNQKGAIYRSPFDRSRHAPYQLHADKLLKNDWLELLAEISATLMASEST

EQMEDALRLERTRLQLQLSGLPDWEYPASLAKPDIEVEIQTALKMQLAKDT

VTSDVLQRAFNLYSSVLSGLTFKLLRRSFSLKMRFSVADTTQLIYVPKVCD

WAIPKQYLQAEGEIGIAARVVTESSPAKMVTEVEMKEPKALGHFMQQAPHD

WYFDASLGGTQVAGRIVEKGKEVGKERKLVGYRMRGNSAYKTVLDKSLVGN

TELSQCSMIIEIPYTQTVDADFRAQVQAGLPKVSINLPVKETITASNKDEQ

MLFDRFVAIDLGERGLGYAVFDAKTLELQESGHRPIKAITNLLNRTHHYEQ

RPNQRQKFQAKFNVNLSELRENTVGDVCHQINRICAYYNAFPVLEYMVPDR

LDKQLKSVYESVTNRYIWSSTDAHKSARVQFWLGGETWEHPYLKSAKDKKP

LVLSPGRGASGKGTSQTCSCCGRNPFDLIKDMKPRAKIAVVDGKAKLENSE

LKLFERNLESKDDMLARRHRNERAGMEQPLTPGNYTVDEIKALLRANLRRA

PKNRRTKDTTVSEYHCVFSDCGKTMHADENAAVNIGGKFIADIEK

-continued

OspCas12c (SEQ ID NO: 220)
MTKLRHRQKKLTHDWAGSKKREVLGSNGKLQNPLLMPVKKGQVTEFRKAFS

AYARATKGEMTDGRKNMFTHSFEPFKTKPSLHQCELADKAYQSLHSYLPGS

LAHFLLSAHALGFRIFSKSGEATAFQASSKIEAYESKLASELACVDLSIQN

LTISTLFNALTTSVRGKGEETSADPLIARFYTLLTGKPLSRDTQGPERDLA

EVISRKIASSFGTWKEMTANPLQSLQFFEEELHALDANVSLSPAFDVLIKM

NDLQGDLKNRTIVFDPDAPVFEYNAEDPADIIKLTARYAKEAVIKNQNVG

NYVKNAITTTNANGLGWLLNKGLSLLPVSTDDELLEFIGVERSHPSCHALI

ELIAQLEAPELFEKNVFSDTRSEVQGMIDSAVSNHIARLSSSRNSLSMDSE

ELERLIKSFQIHTPHCSLFIGAQSLSQQLESLPEALQSGVNSADILLGSTQ

YMLTNSLVEESIATYQRTLNRINYLSGVAGQINGAIKRKAIDGEKIHLPAA

WSELISLPFIGQPVIDVESDLAHLKNQYQTLSNEFDTLISALQKNFDLNFN

KALLNRTQHFEAMCRSTKKNALSKPEIVSYRDLLARLTSCLYRGSLVLRRA

GIEVLKKHKIFESNSELREHVHERKHFVFVSPLDRKAKKLLRLTDSRPDLL

HVIDEILQHDNLENKDRESLWLVRSGYLLAGLPDQLSSSFINLPIITQKGD

RRLIDLIQYDQINRDAFVMLVTSAFKSNLSGLQYRANKQSFVVTRTLSPYL

GSKLVYVPKDKDWLVPSQMFEGRFADILQSDYMVWKDAGRLCVIDTAKHLS

NIKKSVFSSEEVLAFLRELPHRTFIQTEVRGLGVNVDGIAFNNGDIPSLKT

FSNCVQVKVSRTNTSLVQTLNRWFEGGKVSPPSIQFERAYYKKDDQIHEDA

AKRKIRFQMPATELVHASDDAGWTPSYLLGIDPGEYGMGLSLVSINNGEVL

DSGFIHINSLINFASKKSNHQTKVVPRQQYKSPYANYLEQSKDSAAGDIAH

ILDRLIYKLNALPVFEALSGNSQSAADQVWTKVLSFYTWGDNDAQNSIRKQ

HWFGASHWDIKGMLRQPPTEKKPKPYIAFPGSQVSSYGNSQRCSCCGRNPI

EQLREMAKDTSIKELKIRNSEIQLFDGTIKLFNPDPSTVIERRRHNLGPSR

IPVADRTFKNISPSSLEFKELITIVSRSIRHSPEFIAKKRGIGSEYFCAYS

DCNSSLNSEANAAANVAQKFQKQLFFEL

In some embodiments, a napDNAbp refers to Cas12g, Cas12h, or Cas12i, which have been described in, for example, Yan et al., "Functionally Diverse Type V CRISPR-Cas Systems," Science, 2019 Jan. 4; 363: 88-91; the entire contents of each is hereby incorporated by reference. By aggregating more than 10 terabytes of sequence data, new classifications of Type V Cas proteins were identified that showed weak similarity to previously characterized Class V protein, including Cas12g, Cas12h, and Cas12i. In some embodiments, the Cas12 protein is a Cas12g or a variant of Cas12g. In some embodiments, the Cas12 protein is a Cas12h or a variant of Cas12h. In some embodiments, the Cas12 protein is a Cas12i or a variant of Cas12i. It should be appreciated that other RNA-guided DNA binding proteins may be used as a napDNAbp, and are within the scope of this disclosure. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12g, Cas12h, or Cas12i protein. In some embodiments, the napDNAbp is a naturally-occurring Cas12g, Cas12h, or Cas12i protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12g, Cas12h, or Cas12i protein described herein. It should be appreciated that Cas12g, Cas12h, or Cas12i from other bacterial species may also be used in accordance with the present disclosure. In some embodiments, the Cas12i is a Cas12i1 or a Cas12i2.

Cas12g1

(SEQ ID NO: 221)

MAQASSTPAVSPRPRPRYREERTLVRKLLPRPGQSKQEFRENVKKLRKAFL

QFNADVSGVCQWAIQFRPRYGKPAEPTETFWKFFLEPETSLPPNDSRSPEF

RRLQAFEAAAGINGAAALDDPAFTNELRDSILAVASRPKTKEAQRLFSRLK

DYQPAHRMILAKVAAEWIESRYRRAHQNWERNYEEWKKEKQEWEQNHPELT

PEIREAFNQIFQQLEVKEKRVRICPAARLLQNKDNCQYAGKNKHSVLCNQF

NEFKKNHLQGKAIKFFYKDAEKYLRCGLQSLKPNVQGPFREDWNKYLRYMN

LKEETLRGKNGGRLPHCKNLGQECEFNPHTALCKQYQQQLSSRPDLVQHDE

LYRKWRREYWREPRKPVFRYPSVKRHSIAKIFGENYFQADFKNSVVGLRLD

SMPAGQYLEFAFAPWPRNYRPQPGETEISSVHLHFVGTRPRIGFRFRVPHK

RSRFDCTQEELDELRSRTFPRKAQDQKFLEAARKRLLETFPGNAEQELRLL

AVDLGTDSARAAFFIGKTFQQAFPLKIVKIEKLYEQWPNQKQAGDRRDASS

KQPRPGLSRDHVGRHLQKMRAQASEIAQKRQELTGTPAPETTTDQAAKKAT

LQPFDLRGLTVHTARMIRDWARLNARQIIQLAEENQVDLIVLESLRGFRPP

GYENLDQEKKRRVAFFAHGRIRRKVTEKAVERGMRVVTVPYLASSKVCAEC

RKKQKDNKQWEKNKKRGLFKCEGCGSQAQVDENAARVLGRVFWGEIELPTA

IP

Cas12h1

(SEQ ID NO: 222)

MKVHEIPRSQLLKIKQYEGSFVEWYRDLQEDRKKFASLLFRWAAFGYAARE

DDGATYISPSQALLERRLLLGDAEDVAIKFLDVLFKGGAPSSSCYSLFYED

FALRDKAKYSGAKREFIEGLATMPLDKIIERIRQDEQLSKIPAEEWLILGA

EYSPEEIWEQVAPRIVNVDRSLGKQLRERLGIKCRRPHDAGYCKILMEVVA

RQLRSHNETYHEYLNQTHEMKTKVANNLTNEFDLVCEFAEVLEEKNYGLGW

YVLWQGVKQALKEQKKPTKIQIAVDQLRQPKFAGLLTAKWRALKGAYDTWK

LKKRLEKRKAFPYMPNWDNDYQIPVGLTGLGVFTLEVKRTEVVVDLKEHGK

LFCSHSHYFGDLTAEKHPSRYHLKFRHKLKLRKRDSRVEPTIGPWIEAALR

EITIQKKPNGVFYLGLPYALSHGIDNFQIAKRFFSAAKPDKEVINGLPSEM

VVGAADLNLSNIVAPVKARIGKGLEGPLHALDYGYGELIDGPKILTPDGPR

CGELISLKRDIVEIKSAIKEFKACQREGLTMSEETTTWLSEVESPSDSPRC

MIQSRIADTSRRLNSFKYQMNKEGYQDLAEALRLLDAMDSYNSLLESYQRM

HLSPGEQSPKEAKFDTKRASFRDLLRRRVAHTIVEYFDDCDIVFFEDLDGP

SDSDSRNNALVKLLSPRTLLLYIRQALEKRGIGMVEVAKDGTSQNNPISGH

VGWRNKQNKSEIYFYEDKELLVMDADEVGAMNILCRGLNHSVCPYSFVTKA

PEKKNDEKKEGDYGKRVKRFLKDRYGSSNVRFLVASMGFVTVTTKRPKDAL

VGKRLYYHGGELVTHDLHNRMKDEIKYLVEKEVLARRVSLSDSTIKSYKSF

AHV

Cas12i1

(SEQ ID NO: 223)

MSNKEKNASETRKAYTTKMIPRSHDRMKLLGNFMDYLMDGTPIFFELWNQF

GGGIDRDIISGTANKDKISDDLLLAVNWFKVMPINSKPQGVSPSNLANLFQ

QYSGSEPDIQAQEYFASNFDTEKHQWKDMRVEYERLLAELQLSRSDMHHDL

KLMYKEKCIGLSLSTAHYITSVMFGTGAKNNRQTKHQFYSKVIQLLEESTQ

INSVEQLASIILKAGDCDSYRKLRIRCSRKGATPSILKIVQDYELGTNHDD

EVNVPSLIANLKEKLGRFEYECEWKCMEKIKAFLASKVGPYYLGSYSAMLE

NALSPIKGMTTKNCKFVLKQIDAKNDIKYENEPFGKIVEGFFDSPYFESDT

NVKWVLHPHHIGESNIKTLWEDLNAIHSKYEEDIASLSEDKKEKRIKVYQG

DVCQTINTYCEEVGKEAKTPLVQLLRYLYSRKDDIAVDKIIDGITFLSKKH

KVEKQKINPVIQKYPSFNFGNNSKLLGKIISPKDKLKHNLKCNRNQVDNYI

WIEIKVLNTKTMRWEKHHYALSSTRFLEEVYYPATSENPPDALAARFRTKT

NGYEGKPALSAEQIEQIRSAPVGLRKVKKRQMRLEAARQQNLLPRYTWGKD

FNINICKRGNNFEVTLATKVKKKKEKNYKVVLGYDANIVRKNTYAAIEAHA

NGDGVIDYNDLPVKPIESGFVTVESQVRDKSYDQLSYNGVKLLYCKPHVES

RRSFLEKYRNGTMKDNRGNNIQIDFMKDFEAIADDETSLYYFNMKYCKLLQ

SSIRNHSSQAKEYREEIFELLRDGKLSVLKLSSLSNLSFVMFKVAKSLIGT

YFGHLLKKPKNSKSDVKAPPITDEDKQKADPEMFALRLALEEKRLNKVKSK

KEVIANKIVAKALELRDKYGPVLIKGENISDTTKKGKKSSTNSFLMDWLAR

GVANKVKEMVMMHQGLEFVEVNPNFTSHQDPFVHKNPENTFRARYSRCTPS

ELTEKNRKEILSFLSDKPSKRPTNAYYNEGAMAFLATYGLKKNDVLGVSLE

KFKQIMANILHQRSEDQLLFPSRGGMFYLATYKLDADATSVNWNGKQFWVC

NADLVAAYNVGLVDIQKDFKKK

Cas12i2

(SEQ ID NO: 224)

MSSAIKSYKSVLRPNERKNQLLKSTIQCLEDGSAFFFKMLQGLFGGITPEI

VRFSTEQEKQQQDIALWCAVNWFRPVSQDSLTHTIASDNLVEKFEEYYGGT

ASDAIKQYFSASIGESYYWNDCRQQYYDLCRELGVEVSDLTHDLEILCREK

CLAVATESNQNNSIISVLFGTGEKEDRSVKLRITKKILEAISNLKEIPKNV

APIQEIILNVAKATKETFRQVYAGNLGAPSTLEKFIAKDGQKEFDLKKLQT

DLKKVIRGKSKERDWCCQEELRSYVEQNTIQYDLWAWGEMFNKAHTALKIK

STRNYNFAKQRLEQFKEIQSLNNLLVVKKLNDFFDSEFFSGEETYTICVHH

LGGKDLSKLYKAWEDDPADPENAIVVLCDDLKNNFKKEPIRNILRYIFTIR

QECSAQDILAAAKYNQQLDRYKSQKANPSVLGNQGFTWTNAVILPEKAQRN

DRPNSLDLRIWLYLKLRHPDGRWKKHHIPFYDTRFFQEIYAAGNSPVDTCQ

FRTPRFGYHLPKLTDQTAIRVNKKHVKAAKTEARIRLAIQQGTLPVSNLKI

TEISATINSKGQVRIPVKFDVGRQKGTLQIGDRFCGYDQNQTASHAYSLWE

VVKEGQYHKELGCFVRFISSGDIVSITENRGNQFDQLSYEGLAYPQYADWR

KKASKFVSLWQITKKNKKKEIVTVEAKEKFDAICKYQPRLYKFNKEYAYLL

-continued

RDIVRGKSLVELQQIRQEIFRFIEQDCGVTRLGSLSLSTLETVKAVKGIIY

SYFSTALNASKNNPISDEQRKEFDPELFALLEKLELIRTRKKKQKVERIAN

SLIQTCLENNIKFIRGEGDLSTTNNATKKKANSRSMDWLARGVFNKIRQLA    5

PMHNITLFGCGSLYTSHQDPLVHRNPDKAMKCRWAAIPVKDIGDWVLRKLS

-continued

QNLRAKNIGTGEYYHQGVKEFLSHYELQDLEEELLKWRSDRKSNIPCWVLQ

NRLAEKLGNKEAVVYIPVRGGRIYFATHKVATGAVSIVFDQKQVWVCNADH

VAAANIALTVKGIGEQSSDEENPDGSRIKLQLTS

Representative nucleic acid and protein sequences of the base editors follow:

BhCas12b GGSGGS-ABE8-Xten20 at P153 ("GGSGGS" disclosed as SEQ ID NO: 225)

(SEQ ID NO: 226)

GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCggaggctctggaggaagcTCCGAAGTCGAGTTTTCCCATGAGTAC

TGGATGAGACACGCATTGACTCTCGCAAAGAGGGCTCGAGATGAACGCGAGGTGCCCGTGGG

GGCAGTACTCGTGCTCAACAATCGCGTAATCGGCGAAGGTTGGAATAGGGCAATCGGACTCC

ACGACCCCACTGCACATGCGGAAATCATGGCCCTTCGACAGGGAGGGCTTGTGATGCAGAAT

TATCGACTTTATGATGCGACGCTGTACGTCACGTTTGAACCTTGCGTAATGTGCGCGGGAGC

TATGATTCACTCCCGCATTGGACGAGTTGTATTCGGTGTTCGCAACGCCAAGACGGGTGCCG

CAGGTTCACTGATGGACGTGCTGCATCATCCAGGCATGAACCACCGGGTAGAAATCACAGAA

GGCATATTGGCGGACGAATGTGCGGCGCTGTTGTGTCGTTTTTTTCGCATGCCCAGGCGGGT

CTTTAACGCCCAGAAAAAAGCACAATCCTCTACTGACGGCTCTTCTGGATCTGAAACACCTG

GCACAAGCGAGAGCGCCACCCCTGAGAGCTCTGGCTCCTGGGAAGAAGAGAAGAAGAAGTGG

GAAGAAGATAAGAAAAAGGACCCGCTGGCCAAGATCCTGGGCAAGCTGGCTGAGTACGGACT

GATCCCTCTGTTCATCCCCTACACCGACAGCAACGAGCCCATCGTGAAAGAAATCAAGTGGA

TGGAAAAGTCCCGGAACCAGAGCGTGCGGCGGCTGGATAAGGACATGTTCATTCAGGCCCTG

GAACGGTTCCTGAGCTGGGAGAGCTGGAACCTGAAAGTGAAAGAGGAATACGAGAAGGTCGA

GAAAGAGTACAAGACCCTGGAAGAGAGGATCAAAGAGGACATCCAGGCTCTGAAGGCTCTGG

AACAGTATGAGAAAGAGCGGCAAGAACAGCTGCTGCGGGACACCCTGAACACCAACGAGTAC

CGGCTGAGCAAGAGAGGCCTTAGAGGCTGGCGGGAAATCATCCAGAAATGGCTGAAAATGGA

CGAGAACGAGCCCTCCGAGAAGTACCTGGAAGTGTTCAAGGACTACCAGCGGAAGCACCCTA

GAGAGGCCGGCGATTACAGCGTGTACGAGTTCCTGTCCAAGAAAGAGAACCACTTCATCTGG

CGGAATCACCCTGAGTACCCCTACCTGTACGCCACCTTCTGCGAGATCGACAAGAAAAAGAA

GGACGCCAAGCAGCAGGCCACCTTCACACTGGCCGATCCTATCAATCACCCTCTGTGGGTCC

-continued

```
GATTCGAGGAAAGAAGCGGCAGCAACCTGAACAAGTACAGAATCCTGACCGAGCAGCTGCAC

ACCGAGAAGCTGAAGAAAAAGCTGACAGTGCAGCTGGACCGGCTGATCTACCCTACAGAATC

TGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGC

ATCAAGTTCCCTCTGAAGGGCACACTCGGCGGAGCCAGAGTGCAGTTCGACAGAGATCACCT

GAGAAGATACCCTCACAAGGTGGAAAGCGGCAACGTGGGCAGAATCTACTTCAACATGACCG

TGAACATCGAGCCTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGACAGCAAGGGCAA

GAAACTGAAGTCCGGCATCGAGTCCCTGGAAATCGGCCTGAGAGTGATGAGCATCGACCTGG

GACAGAGACAGGCCGCTGCCGCCTCTATTTTCGAGGTGGTGGATCAGAAGCCCGACATCGAA

GGCAAGCTGTTTTTCCCAATCAAGGGCACCGAGCTGTATGCCGTGCACAGAGCCAGCTTCAA

CATCAAGCTGCCCGGCGAGACACTGGTCAAGAGCAGAGAAGTGCTGCGGAAGGCCAGAGAGG

ACAATCTGAAACTGATGAACCAGAAGCTCAACTTCCTGCGGAACGTGCTGCACTTCCAGCAG

TTCGAGGACATCACCGAGAGAGAGAAGCGGGTCACCAAGTGGATCAGCAGACAAGAGAACAG

CGACGTGCCCCTGGTGTACCAGGATGAGCTGATCCAGATCCGCGAGCTGATGTACAAGCCTT

ACAAGGACTGGGTCGCCTTCCTGAAGCAGCTCCACAAGAGACTGGAAGTCGAGATCGGCAAA

GAAGTGAAGCACTGGCGGAAGTCCCTGAGCGACGGAAGAAAGGGCCTGTACGGCATCTCCCT

GAAGAACATCGACGAGATCGATCGGACCCGGAAGTTCCTGCTGAGATGGTCCCTGAGGCCTA

CCGAACCTGGCGAAGTGCGTAGACTGGAACCCGGCCAGAGATTCGCCATCGACCAGCTGAAT

CACCTGAACGCCCTGAAAGAAGATCGGCTGAAGAAGATGGCCAACACCATCATCATGCACGC

CCTGGGCTACTGCTACGACGTGCGGAAGAAGAAATGGCAGGCTAAGAACCCCGCCTGCCAGA

TCATCCTGTTCGAGGATCTGAGCAACTACAACCCCTACGAGGAAAGGTCCCGCTTCGAGAAC

AGCAAGCTCATGAAGTGGTCCAGACGCGAGATCCCCAGACAGGTTGCACTGCAGGGCGAGAT

CTATGGCCTGCAAGTGGGAGAAGTGGGCGCTCAGTTCAGCAGCAGATTCCACGCCAAGACAG

GCAGCCCTGGCATCAGATGTAGCGTCGTGACCAAAGAGAAGCTGCAGGACAATCGGTTCTTC

AAGAATCTGCAGAGAGAGGGCAGACTGACCCTGGACAAAATCGCCGTGCTGAAAGAGGGCGA

TCTGTACCCAGACAAAGGCGGCGAGAAGTTCATCAGCCTGAGCAAGGATCGGAAGTGCGTGA

CCACACACGCCGACATCAACGCCGCTCAGAACCTGCAGAAGCGGTTCTGGACAAGAACCCAC

GGCTTCTACAAGGTGTACTGCAAGGCCTACCAGGTGGACGGCCAGACCGTGTACATCCCT

GAGAGCAAGGACCAGAAGCAGAAGATCATCGAAGAGTTCGGCGAGGGCTACTTCATTCTGAA

GGACGGGGTGTACGAATGGGTCAACGCCGGCAAGCTGAAAATCAAGAAGGGCAGCTCCAAGC

AGAGCAGCAGCGAGCTGGTGGATAGCGACATCCTGAAAGACAGCTTCGACCTGGCCTCCGAG

CTGAAAGGCGAAAAGCTGATGCTGTACAGGGACCCCAGCGGCAATGTGTTCCCCAGCGACAA

ATGGATGGCCGCTGGCGTGTTCTTCGGAAAGCTGGAACGCATCCTGATCAGCAAGCTGACCA

ACCAGTACTCCATCAGCACCATCGAGGACGACAGCAGCAAGCAGTCTATG<u>AAAAGGCCGGCG</u>

<u>GCCACGAAAAAGGCCGGCCAGGCAAAAAAGAAAAAGGG</u>ATCC*TACCCATACGATGTTCCAGA*

*TTACGCTTATCCCTACGACGTGCCTGATTATGCATACCCATATGATGTCCCCGACTATGCCT*

*AA*
```

(SEQ ID NO: 227)

```
MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE
```

-continued

KKGEANQLSNKFLYPLVDPNSQSGKGTASSGRKPRWYNLKIAGDPGGSGGSSEVEFSHEYWM

RHALTLAKRARDEREVPVGAVLVLNNRVIGEGWNRAIGLHDPTAHAEIMALRQGGLVMQNYR

LYDATLYVTFEPCVMCAGAMIHSRIGRVVFGVRNAKTGAAGSLMDVLHHPGMNHRVEITEGI

LADECAALLCRFFRMPRRVFNAQKKAQSSTDGSSGSETPGTSESATPESSGSWEEEKKKWEE

DKKKDPLAKILGKLAEYGLIPLFIPYTDSNEPIVKEIKWMEKSRNQSVRRLDKDMFIQALER

FLSWESWNLKVKEEYEKVEKEYKTLEERIKEDIQALKALEQYEKERQEQLLRDTLNTNEYRL

SKRGLRGWREIIQKWLKMDENEPSEKYLEVFKDYQRKHPREAGDYSVYEFLSKKENHFIWRN

HPEYPYLYATFCEIDKKKKDAKQQATFTLADPINHPLWVRFEERSGSNLNKYRILTEQLHTE

KLKKKLTVQLDRLIYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPVSKSLKIHRDDFPK

VVNFKPKELTEWIKDSKGKKLKSGIESLEIGLRVMSIDLGQRQAAAASIFEVVDQKPDIEGK

LFFPIKGTELYAVHRASFNIKLPGETLVKSREVLRKAREDNLKLMNQKLNFLRNVLHFQQFE

DITEREKRVTKWISRQENSDVPLVYQDELIQIRELMYKPYKDWVAFLKQLHKRLEVEIGKEV

KHWRKSLSDGRKGLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYNPYEERSRFENSK

LMKWSRREIPRQVALQGEIYGLQVGEVGAQFSSRFHAKTGSPGIRCSVVTKEKLQDNRFFKN

LQREGRLTLDKIAVLKEGDLYPDKGGEKFISLSKDRKCVTTHADINAAQNLQKRFWTRTHGF

YKVYCKAYQVDGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA

BhCas12b GGSGGS-ABE8-Xten20 at K255 ("GGSGGS" disclosed as
SEQ ID NO: 225)

(SEQ ID NO: 228)

GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAggaggctctggaggaagcTCCGAAGTCGAGTTTTCCCATGAGTACT

GGATGAGACACGCATTGACTCTCGCAAAGAGGGCTCGAGATGAACGCGAGGTGCCCGTGGGG

GCAGTACTCGTGCTCAACAATCGCGTAATCGGCGAAGGTTGGAATAGGGCAATCGGACTCCA

-continued
CGACCCCACTGCACATGCGGAAATCATGGCCCTTCGACAGGGAGGGCTTGTGATGCAGAATT

ATCGACTTTATGATGCGACGCTGTACGTCACGTTTGAACCTTGCGTAATGTGCGCGGGAGCT

ATGATTCACTCCCGCATTGGACGAGTTGTATTCGGTGTTCGCAACGCCAAGACGGGTGCCGC

AGGTTCACTGATGGACGTGCTGCATCATCCAGGCATGAACCACCGGGTAGAAATCACAGAAG

GCATATTGGCGGACGAATGTGCGGCGCTGTTGTGTCGTTTTTTTCGCATGCCCAGGCGGGTC

TTTAACGCCCAGAAAAAAGCACAATCCTCTACTGACGGCTCTTCTGGATCTGAAACACCTGG

CACAAGCGAGAGCGCCACCCCTGAGAGCTCTGGCGAGGACATCCAGGCTCTGAAGGCTCTGG

AACAGTATGAGAAAGAGCGGCAAGAACAGCTGCTGCGGGACACCCTGAACACCAACGAGTAC

CGGCTGAGCAAGAGAGGCCTTAGAGGCTGGCGGGAAATCATCCAGAAATGGCTGAAAATGGA

CGAGAACGAGCCCTCCGAGAAGTACCTGGAAGTGTTCAAGGACTACCAGCGGAAGCACCCTA

GAGAGGCCGGCGATTACAGCGTGTACGAGTTCCTGTCCAAGAAAGAGAACCACTTCATCTGG

CGGAATCACCCTGAGTACCCCTACCTGTACGCCACCTTCTGCGAGATCGACAAGAAAAAGAA

GGACGCCAAGCAGCAGGCCACCTTCACACTGGCCGATCCTATCAATCACCCTCTGTGGGTCC

GATTCGAGGAAAGAAGCGGCAGCAACCTGAACAAGTACAGAATCCTGACCGAGCAGCTGCAC

ACCGAGAAGCTGAAGAAAAAGCTGACAGTGCAGCTGGACCGGCTGATCTACCCTACAGAATC

TGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGC

ATCAAGTTCCCTCTGAAGGGCACACTCGGCGGAGCCAGAGTGCAGTTCGACAGAGATCACCT

GAGAAGATACCCTCACAAGGTGGAAAGCGGCAACGTGGGCAGAATCTACTTCAACATGACCG

TGAACATCGAGCCTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGACAGCAAGGGCAA

GAAACTGAAGTCCGGCATCGAGTCCCTGGAAATCGGCCTGAGAGTGATGAGCATCGACCTGG

GACAGAGACAGGCCGCTGCCGCCTCTATTTTCGAGGTGGTGGATCAGAAGCCCGACATCGAA

GGCAAGCTGTTTTTTCCCAATCAAGGGCACCGAGCTGTATGCCGTGCACAGAGCCAGCTTCAA

CATCAAGCTGCCCGGCGAGACACTGGTCAAGAGCAGAGAAGTGCTGCGGAAGGCCAGAGAGG

ACAATCTGAAACTGATGAACCAGAAGCTCAACTTCCTGCGGAACGTGCTGCACTTCCAGCAG

TTCGAGGACATCACCGAGAGAGAGAAGCGGGTCACCAAGTGGATCAGCAGACAAGAGAACAG

CGACGTGCCCCTGGTGTACCAGGATGAGCTGATCCAGATCCGCGAGCTGATGTACAAGCCTT

ACAAGGACTGGGTCGCCTTCCTGAAGCAGCTCCACAAGAGACTGGAAGTCGAGATCGGCAAA

GAAGTGAAGCACTGGCGGAAGTCCCTGAGCGACGGAAGAAAGGGCCTGTACGGCATCTCCCT

GAAGAACATCGACGAGATCGATCGGACCCGGAAGTTCCTGCTGAGATGGTCCCTGAGGCCTA

CCGAACCTGGCGAAGTGCGTAGACTGGAACCCGGCCAGAGATTCGCCATCGACCAGCTGAAT

CACCTGAACGCCCTGAAAGAAGATCGGCTGAAGAAGATGGCCAACACCATCATCATGCACGC

CCTGGGCTACTGCTACGACGTGCGGAAGAAGAAATGGCAGGCTAAGAACCCCGCCTGCCAGA

TCATCCTGTTCGAGGATCTGAGCAACTACAACCCCTACGAGGAAAGGTCCCGCTTCGAGAAC

AGCAAGCTCATGAAGTGGTCCAGACGCGAGATCCCCAGACAGGTTGCACTGCAGGGCGAGAT

CTATGGCCTGCAAGTGGGAGAAGTGGGCGCTCAGTTCAGCAGCAGATTCCACGCCAAGACAG

GCAGCCCTGGCATCAGATGTAGCGTCGTGACCAAAGAGAAGCTGCAGGACAATCGGTTCTTC

-continued

AAGAATCTGCAGAGAGAGGGCAGACTGACCCTGGACAAAATCGCCGTGCTGAAAGAGGGCGA

TCTGTACCCAGACAAAGGCGGCGAGAAGTTCATCAGCCTGAGCAAGGATCGGAAGTGCGTGA

CCACACACGCCGACATCAACGCCGCTCAGAACCTGCAGAAGCGGTTCTGGACAAGAACCCAC

GGCTTCTACAAGGTGTACTGCAAGGCCTACCAGGTGGACGGCCAGACCGTGTACATCCCTGA

GAGCAAGGACCAGAAGCAGAAGATCATCGAAGAGTTCGGCGAGGGCTACTTCATTCTGAAGG

ACGGGGTGTACGAATGGGTCAACGCCGGCAAGCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATG<u>AAAAGGCCGGCGGC</u>

<u>CACGAAAAGGCCGGCCAGGCAAAAAAGAAAAAGGG</u>*ATCC*TACCCATACGATGTTCCAGATT

*ACGCTTATCCCTACGACGTGCCTGATTATGCATACCCATATGATGTCCCCGACTATGCCTAA*

(SEQ ID NO: 229)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKGGSGGSSEVEFSHEYWMRHALTLAKRARDEREVPVGAV

LVLNNRVIGEGWNRAIGLHDPTAHAEIMALRQGGLVMQNYRLYDATLYVTFEPCVMCAGAMI

HSRIGRVVFGVRNAKTGAAGSLMDVLHHPGMNHRVEITEGILADECAALLCRFFRMPRRVFN

AQKKAQSSTDGSSGSETPGTSESATPESSGEDIQALKALEQYEKERQEQLLRDTLNTNEYRL

SKRGLRGWREIIQKWLKMDENEPSEKYLEVFKDYQRKHPREAGDYSVYEFLSKKENHFIWRN

HPEYPYLYATFCEIDKKKKDAKQQATFTLADPINHPLWVRFEERSGSNLNKYRILTEQLHTE

KLKKKLTVQLDRLIYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPVSKSLKIHRDDFPK

VVNFKPKELTEWIKDSKGKKLKSGIESLEIGLRVMSIDLGQRQAAAASIFEVVDQKPDIEGK

LFFPIKGTELYAVHRASFNIKLPGETLVKSREVLRKAREDNLKLMNQKLNFLRNVLHFQQFE

DITEREKRVTKWISRQENSDVPLVYQDELIQIRELMYKPYKDWVAFLKQLHKRLEVEIGKEV

KHWRKSLSDGRKGLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYNPYEERSRFENSK

LMKWSRREIPRQVALQGEIYGLQVGEVGAQFSSRFHAKTGSPGIRCSVVTKEKLQDNRFFKN

LQREGRLTLDKIAVLKEGDLYPDKGGEKFISLSKDRKCVTTHADINAAQNLQKRFWTRTHGF

YKVYCKAYQVDGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA

BhCas12b GGSGGS-ABE8-Xten20 at D306 ("GGSGGS" disclosed as
SEQ ID NO: 225)

(SEQ ID NO: 230)

<u>GCCACC</u><u>ATGGCCCCAAAGAAGAAGCGGAAGGTCGGTATCCACGGAGTCCCAGCAGCC</u>GCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

US 12,600,971 B2

227

228

-continued

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGTATGAGAAAGAGC

GGCAAGAACAGCTGCTGCGGGACACCCTGAACACCAACGAGTACCGGCTGAGCAAGAGAGGC

CTTAGAGGCTGGCGGGAAATCATCCAGAAATGGCTGAAAATGGACggaggctctggaggaag cTCCGAAGTCGAGTTTTCCCATGAGTACTGGATGAGACACGCATTGACTCTCGCAAAGAGGG

CTCGAGATGAACGCGAGGTGCCCGTGGGGGCAGTACTCGTGCTCAACAATCGCGTAATCGGC

GAAGGTTGGAATAGGGCAATCGGACTCCACGACCCCACTGCACATGCGGAAATCATGGCCCT

TCGACAGGGAGGGCTTGTGATGCAGAATTATCGACTTTATGATGCGACGCTGTACGTCACGT

TTGAACCTTGCGTAATGTGCGCGGGAGCTATGATTCACTCCCGCATTGGACGAGTTGTATTC

GGTGTTCGCAACGCCAAGACGGGTGCCGCAGGTTCACTGATGGACGTGCTGCATCATCCAGG

CATGAACCACCGGGTAGAAATCACAGAAGGCATATTGGCGGACGAATGTGCGGCGCTGTTGT

GTCGTTTTTTTCGCATGCCCAGGCGGGTCTTTAACGCCCAGAAAAAAGCACAATCCTCTACT

GACGGCTCTTCTGGATCTGAAACACCTGGCACAAGCGAGAGCGCCACCCCTGAGAGCTCTGG

CGAGAACGAGCCCTCCGAGAAGTACCTGGAAGTGTTCAAGGACTACCAGCGGAAGCACCCTA

GAGAGGCCGGCGATTACAGCGTGTACGAGTTCCTGTCCAAGAAAGAGAACCACTTCATCTGG

CGGAATCACCCTGAGTACCCCTACCTGTACGCCACCTTCTGCGAGATCGACAAGAAAAAGAA

GGACGCCAAGCAGCAGGCCACCTTCACACTGGCCGATCCTATCAATCACCCTCTGTGGGTCC

GATTCGAGGAAAGAAGCGGCAGCAACCTGAACAAGTACAGAATCCTGACCGAGCAGCTGCAC

ACCGAGAAGCTGAAGAAAAAGCTGACAGTGCAGCTGGACCGGCTGATCTACCCTACAGAATC

TGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGC

ATCAAGTTCCCTCTGAAGGGCACACTCGGCGGAGCCAGAGTGCAGTTCGACAGAGATCACCT

GAGAAGATACCCTCACAAGGTGGAAAGCGGCAACGTGGGCAGAATCTACTTCAACATGACCG

TGAACATCGAGCCTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGACAGCAAGGGCAA

GAAACTGAAGTCCGGCATCGAGTCCCTGGAAATCGGCCTGAGAGTGATGAGCATCGACCTGG

GACAGAGACAGGCCGCTGCCGCCTCTATTTTCGAGGTGGTGGATCAGAAGCCCGACATCGAA

GGCAAGCTGTTTTTTCCCAATCAAGGGCACCGAGCTGTATGCCGTGCACAGAGCCAGCTTCAA

-continued

```
CATCAAGCTGCCCGGCGAGACACTGGTCAAGAGCAGAGAAGTGCTGCGGAAGGCCAGAGAGG

ACAATCTGAAACTGATGAACCAGAAGCTCAACTTCCTGCGGAACGTGCTGCACTTCCAGCAG

TTCGAGGACATCACCGAGAGAGAGAAGCGGGTCACCAAGTGGATCAGCAGACAAGAGAACAG

CGACGTGCCCCTGGTGTACCAGGATGAGCTGATCCAGATCCGCGAGCTGATGTACAAGCCTT

ACAAGGACTGGGTCGCCTTCCTGAAGCAGCTCCACAAGAGACTGGAAGTCGAGATCGGCAAA

GAAGTGAAGCACTGGCGGAAGTCCCTGAGCGACGGAAGAAAGGGCCTGTACGGCATCTCCCT

GAAGAACATCGACGAGATCGATCGGACCCGGAAGTTCCTGCTGAGATGGTCCCTGAGGCCTA

CCGAACCTGGCGAAGTGCGTAGACTGGAACCCGGCCAGAGATTCGCCATCGACCAGCTGAAT

CACCTGAACGCCCTGAAAGAAGATCGGCTGAAGAAGATGGCCAACACCATCATCATGCACGC

CCTGGGCTACTGCTACGACGTGCGGAAGAAGAAATGGCAGGCTAAGAACCCCGCCTGCCAGA

TCATCCTGTTCGAGGATCTGAGCAACTACAACCCCTACGAGGAAAGGTCCCGCTTCGAGAAC

AGCAAGCTCATGAAGTGGTCCAGACGCGAGATCCCCAGACAGGTTGCACTGCAGGGCGAGAT

CTATGGCCTGCAAGTGGGAGAAGTGGGCGCTCAGTTCAGCAGCAGATTCCACGCCAAGACAG

GCAGCCCTGGCATCAGATGTAGCGTCGTGACCAAAGAGAAGCTGCAGGACAATCGGTTCTTC

AAGAATCTGCAGAGAGAGGGCAGACTGACCCTGGACAAAATCGCCGTGCTGAAAGAGGGCGA

TCTGTACCCAGACAAAGGCGGCGAGAAGTTCATCAGCCTGAGCAAGGATCGGAAGTGCGTGA

CCACACACGCCGACATCAACGCCGCTCAGAACCTGCAGAAGCGGTTCTGGACAAGAACCCAC

GGCTTCTACAAGGTGTACTGCAAGGCCTACCAGGTGGACGGCCAGACCGTGTACATCCCTGA

GAGCAAGGACCAGAAGCAGAAGATCATCGAAGAGTTCGGCGAGGGCTACTTCATTCTGAAGG

ACGGGGTGTACGAATGGGTCAACGCCGGCAAGCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATG$\underline{AAAAGGCCGGCGGC}$
```

$\underline{CACGAAAAGGCCGGCCAGGCAAAAAAGAAAAAGGG}\underline{ATCC}$*TACCCATACGATGTTCCAGATT*

*ACGCTTATCCCTACGACGTGCCTGATTATGCATACCCATATGATGTCCCCGACTATGCC*TAA (SEQ ID NO: 231)

```
MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDGGSGGSSEVEFSHEYWMRHALTLAKRARDEREVPVGAVLVLNNRVIGEG

WNRAIGLHDPTAHAEIMALRQGGLVMQNYRLYDATLYVTFEPCVMCAGAMIHSRIGRVVFGV

RNAKTGAAGSLMDVLHHPGMNHRVEITEGILADECAALLCRFFRMPRRVFNAQKKAQSSIDG

SSGSETPGTSESATPESSGENEPSEKYLEVFKDYQRKHPREAGDYSVYEFLSKKENHFIWRN

HPEYPYLYATFCEIDKKKKDAKQQATFTLADPINHPLWVRFEERSGSNLNKYRILTEQLHTE

KLKKKLTVQLDRLIYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPVSKSLKIHRDDFPK

VVNFKPKELTEWIKDSKGKKLKSGIESLEIGLRVMSIDLGQRQAAAASIFEVVDQKPDIEGK

LFFPIKGTELYAVHRASFNIKLPGETLVKSREVLRKAREDNLKLMNQKLNFLRNVLHFQQFE
```

-continued

DITEREKRVTKWISRQENSDVPLVYQDELIQIRELMYKPYKDWVAFLKQLHKRLEVEIGKEV

KHWRKSLSDGRKGLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYNPYEERSRFENSK

LMKWSRREIPRQVALQGEIYGLQVGEVGAQFSSRFHAKTGSPGIRCSVVTKEKLQDNRFFKN

LQREGRLTLDKIAVLKEGDLYPDKGGEKFISLSKDRKCVTTHADINAAQNLQKRFWTRTHGF

YKVYCKAYQVDGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA

BhCas12b GGSGGS-ABE8-Xten20 at D980 ("GGSGGS" disclosed as
SEQ ID NO: 225)
                                              (SEQ ID NO: 232)
GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGTATGAGAAAGAGC

GGCAAGAACAGCTGCTGCGGGACACCCTGAACACCAACGAGTACCGGCTGAGCAAGAGAGGC

CTTAGAGGCTGGCGGGAAATCATCCAGAAATGGCTGAAAATGGACGAGAACGAGCCCTCCGA

GAAGTACCTGGAAGTGTTCAAGGACTACCAGCGGAAGCACCCTAGAGAGGCCGGCGATTACA

GCGTGTACGAGTTCCTGTCCAAGAAAGAGAACCACTTCATCTGGCGGAATCACCCTGAGTAC

CCCTACCTGTACGCCACCTTCTGCGAGATCGACAAGAAAAAGAAGGACGCCAAGCAGCAGGC

CACCTTCACACTGGCCGATCCTATCAATCACCCTCTGTGGGTCCGATTCGAGGAAAGAAGCG

GCAGCAACCTGAACAAGTACAGAATCCTGACCGAGCAGCTGCACACCGAGAAGCTGAAGAAA

AAGCTGACAGTGCAGCTGGACCGGCTGATCTACCCTACAGAATCTGGCGGCTGGGAAGAGAA

GGGCAAAGTGGACATTGTGCTGCTGCCCAGCCGGCAGTTCTACAACCAGATCTTCCTGGACA

TCGAGGAAAAGGGCAAGCACGCCTTCACCTACAAGGATGAGAGCATCAAGTTCCCTCTGAAG

GGCACACTCGGCGGAGCCAGAGTGCAGTTCGACAGAGATCACCTGAGAAGATACCCTCACAA

GGTGGAAAGCGGCAACGTGGGCAGAATCTACTTCAACATGACCGTGAACATCGAGCCTACAG

AGTCCCCAGTGTCCAAGTCTCTGAAGATCCACCGGGACGACTTCCCCAAGGTGGTCAACTTC

AAGCCCAAAGAACTGACCGAGTGGATCAAGGACAGCAAGGGCAAGAAACTGAAGTCCGGCAT

CGAGTCCCTGGAAATCGGCCTGAGAGTGATGAGCATCGACCTGGGACAGAGACAGGCCGCTG

CCGCCTCTATTTTCGAGGTGGTGGATCAGAAGCCCGACATCGAAGGCAAGCTGTTTTTCCCA

-continued

```
ATCAAGGGCACCGAGCTGTATGCCGTGCACAGAGCCAGCTTCAACATCAAGCTGCCCGGCGA

GACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAG

AGAGAGAAGCGGGTCACCCAAGTGGATCAGCAGACAAGAGAACAGCGACGTGCCCCTGGTGTA

CCAGGATGAGCTGATCCAGATCCGCGAGCTGATGTACAAGCCTTACAAGGACTGGGTCGCCT

TCCTGAAGCAGCTCCACAAGAGACTGGAAGTCGAGATCGGCAAAGAAGTGAAGCACTGGCGG

AAGTCCCTGAGCGACGGAAGAAAGGGCCTGTACGGCATCTCCCTGAAGAACATCGACGAGAT

CGATCGGACCCGGAAGTTCCTGCTGAGATGGTCCCTGAGGCCTACCGAACCTGGCGAAGTGC

GTAGACTGGAACCCGGCCAGAGATTCGCCATCGACCAGCTGAATCACCTGAACGCCCTGAAA

GAAGATCGGCTGAAGAAGATGGCCAACACCATCATCATGCACGCCCTGGGCTACTGCTACGA

CGTGCGGAAGAAGAAATGGCAGGCTAAGAACCCCGCCTGCCAGATCATCCTGTTCGAGGATC

TGAGCAACTACAACCCCTACGAGGAAAGGTCCCGCTTCGAGAACAGCAAGCTCATGAAGTGG

TCCAGACGCGAGATCCCCAGACAGGTTGCACTGCAGGGCGAGATCTATGGCCTGCAAGTGGG

AGAAGTGGGCGCTCAGTTCAGCAGCAGATTCCACGCCAAGACAGGCAGCCCTGGCATCAGAT

GTAGCGTCGTGACCAAAGAGAAGCTGCAGGACAATCGGTTCTTCAAGAATCTGCAGAGAGAG

GGCAGACTGACCCTGGACAAAATCGCCGTGCTGAAAGAGGGCGATCTGTACCCAGACAAAGG

CGGCGAGAAGTTCATCAGCCTGAGCAAGGATCGGAAGTGCGTGACCACACACGCCGACATCA

ACGCCGCTCAGAACCTGCAGAAGCGGTTCTGGACAAGAACCCACGGCTTCTACAAGGTGTAC

TGCAAGGCCTACCAGGTGGACggaggctctggaggaagcTCCGAAGTCGAGTTTTCCCATGA

GTACTGGATGAGACACGCATTGACTCTCGCAAAGAGGGCTCGAGATGAACGCGAGGTGCCCG

TGGGGGCAGTACTCGTGCTCAACAATCGCGTAATCGGCGAAGGTTGGAATAGGGCAATCGGA

CTCCACGACCCCACTGCACATGCGGAAATCATGGCCCTTCGACAGGGAGGGCTTGTGATGCA

GAATTATCGACTTTATGATGCGACGCTGTACGTCACGTTTGAACCTTGCGTAATGTGCGCGG

GAGCTATGATTCACTCCCGCATTGGACGAGTTGTATTCGGTGTTCGCAACGCCAAGACGGGT

GCCGCAGGTTCACTGATGGACGTGCTGCATCATCCAGGCATGAACCACCGGGTAGAAATCAC

AGAAGGCATATTGGCGGACGAATGTGCGGCGCTGTTGTGTCGTTTTTTTCGCATGCCCAGGC

GGGTCTTTAACGCCCAGAAAAAAGCACAATCCTCTACTGACGGCTCTTCTGGATCTGAAACA

CCTGGCACAAGCGAGAGCGCCACCCCTGAGAGCTCTGGCGGCCAGACCGTGTACATCCCTGA

GAGCAAGGACCAGAAGCAGAAGATCATCGAAGAGTTCGGCGAGGGCTACTTCATTCTGAAGG

ACGGGGTGTACGAATGGGTCAACGCCGGCAAGCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATGAAAAGGCCGGCGGC

CACGAAAAAGGCCGGCCAGGCAAAAAAGAAAAAGGGATCCTACCCATACGATGTTCCAGATT

ACGCTTATCCCTACGACGTGCCTGATTATGCATACCCATATGATGTCCCCGACTATGCCTAA
```

-continued (SEQ ID NO: 233)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDENEPSEKYLEVFKDYQRKHPREAGDYSVYEFLSKKENHFIWRNHPEYPY

LYATFCEIDKKKKDAKQQATFTLADPINHPLWVRFEERSGSNLNKYRILTEQLHTEKLKKKL

TVQLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKVVNFKP

KELTEWIKDSKGKKLKSGIESLEIGLRVMSIDLGQRQAAAASIFEVVDQKPDIEGKLFFPIK

GTELYAVHRASFNIKLPGETLVKSREVLRKAREDNLKLMNQKLNFLRNVLHFQQFEDITERE

KRVTKWISRQENSDVPLVYQDELIQIRELMYKPYKDWVAFLKQLHKRLEVEIGKEVKHWRKS

LSDGRKGLYGISLKNIDEIDRTRKFLLRWSLRPTEPGEVRRLEPGQRFAIDQLNHLNALKED

RLKKMANTIIMHALGYCYDVRKKKWQAKNPACQIILFEDLSNYNPYEERSRFENSKLMKWSR

REIPRQVALQGEIYGLQVGEVGAQFSSRFHAKTGSPGIRCSVVTKEKLQDNRFFKNLQREGR

LTLDKIAVLKEGDLYPDKGGEKFISLSKDRKCVTTHADINAAQNLQKRFWTRTHGFYKVYCK

AYQVDGGSGGSSEVEFSHEYWMRHALTLAKRARDEREVPVGAVLVLNNRVIGEGWNRAIGLH

DPTAHAEIMALRQGGLVMQNYRLYDATLYVTFEPCVMCAGAMIHSRIGRVVFGVRNAKTGAA

GSLMDVLHHPGMNHRVEITEGILADECAALLCRFFRMPRRVFNAQKKAQSSTDGSSGSETPG

TSESATPESSGGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA

BhCas12b GGSGGS-ABE8-Xten20 at K1019 ("GGSGGS" disclosed as
SEQ ID NO: 225)

(SEQ ID NO: 234)

GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGTATGAGAAAGAGC

GGCAAGAACAGCTGCTGCGGGACACCCTGAACACCAACGAGTACCGGCTGAGCAAGAGAGGC

CTTAGAGGCTGGCGGGAAATCATCCAGAAATGGCTGAAAATGGACGAGAACGAGCCCTCCGA

-continued

```
GAAGTACCTGGAAGTGTTCAAGGACTACCAGCGGAAGCACCCTAGAGAGGCCGGCGATTACA

GCGTGTACGAGTTCCTGTCCAAGAAAGAGAACCACTTCATCTGGCGGAATCACCCTGAGTAC

CCCTACCTGTACGCCACCTTCTGCGAGATCGACAAGAAAAAGAAGGACGCCAAGCAGCAGGC

CACCTTCACACTGGCCGATCCTATCAATCACCCTCTGTGGGTCCGATTCGAGGAAAGAAGCG

GCAGCAACCTGAACAAGTACAGAATCCTGACCGAGCAGCTGCACACCGAGAAGCTGAAGAAA

AAGCTGACAGTGCAGCTGGACCGGCTGATCTACCCTACAGAATCTGGCGGCTGGGAAGAGAA

GGGCAAAGTGGACATTGTGCTGCTGCCCAGCCGGCAGTTCTACAACCAGATCTTCCTGGACA

TCGAGGAAAAGGGCAAGCACGCCTTCACCTACAAGGATGAGAGCATCAAGTTCCCTCTGAAG

GGCACACTCGGCGGAGCCAGAGTGCAGTTCGACAGAGATCACCTGAGAAGATACCCTCACAA

GGTGGAAAGCGGCAACGTGGGCAGAATCTACTTCAACATGACCGTGAACATCGAGCCTACAG

AGTCCCCAGTGTCCAAGTCTCTGAAGATCCACCGGGACGACTTCCCCAAGGTGGTCAACTTC

AAGCCCAAAGAACTGACCGAGTGGATCAAGGACAGCAAGGGCAAGAAACTGAAGTCCGGCAT

CGAGTCCCTGGAAATCGGCCTGAGAGTGATGAGCATCGACCTGGGACAGAGACAGGCCGCTG

CCGCCTCTATTTTCGAGGTGGTGGATCAGAAGCCCGACATCGAAGGCAAGCTGTTTTTCCCA

ATCAAGGGCACCGAGCTGTATGCCGTGCACAGAGCCAGCTTCAACATCAAGCTGCCCGGCGA

GACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAG

AGAGAGAAGCGGGTCACCAAGTGGATCAGCAGACAAGAGAACAGCGACGTGCCCCTGGTGTA

CCAGGATGAGCTGATCCAGATCCGCGAGCTGATGTACAAGCCTTACAAGGACTGGGTCGCCT

TCCTGAAGCAGCTCCACAAGAGACTGGAAGTCGAGATCGGCAAAGAAGTGAAGCACTGGCGG

AAGTCCCTGAGCGACGGAAGAAAGGGCCTGTACGGCATCTCCCTGAAGAACATCGACGAGAT

CGATCGGACCCGGAAGTTCCTGCTGAGATGGTCCCTGAGGCCTACCGAACCTGGCGAAGTGC

GTAGACTGGAACCCGGCCAGAGATTCGCCATCGACCAGCTGAATCACCTGAACGCCCTGAAA

GAAGATCGGCTGAAGAAGATGGCCAACACCATCATCATGCACGCCCTGGGCTACTGCTACGA

CGTGCGGAAGAAGAAATGGCAGGCTAAGAACCCCGCCTGCCAGATCATCCTGTTCGAGGATC

TGAGCAACTACAACCCCTACGAGGAAAGGTCCCGCTTCGAGAACAGCAAGCTCATGAAGTGG

TCCAGACGCGAGATCCCCAGACAGGTTGCACTGCAGGGCGAGATCTATGGCCTGCAAGTGGG

AGAAGTGGGCGCTCAGTTCAGCAGCAGATTCCACGCCAAGACAGGCAGCCCTGGCATCAGAT

GTAGCGTCGTGACCAAAGAGAAGCTGCAGGACAATCGGTTCTTCAAGAATCTGCAGAGAGAG

GGCAGACTGACCCTGGACAAAATCGCCGTGCTGAAAGAGGGCGATCTGTACCCAGACAAAGG

CGGCGAGAAGTTCATCAGCCTGAGCAAGGATCGGAAGTGCGTGACCACACACGCCGACATCA

ACGCCGCTCAGAACCTGCAGAAGCGGTTCTGGACAAGAACCCACGGCTTCTACAAGGTGTAC

TGCAAGGCCTACCAGGTGGACGGCCAGACCGTGTACATCCCTGAGAGCAAGGACCAGAAGCA

GAAGATCATCGAAGAGTTCGGCGAGGGCTACTTCATTCTGAAGGACGGGGTGTACGAATGGG

TCAACGCCGGCAAGggaggctctggaggaagcTCCGAAGTCGAGTTTTCCCATGAGTACTGG
```
                                     _____

```
ATGAGACACGCATTGACTCTCGCAAAGAGGGCTCGAGATGAACGCGAGGTGCCCGTGGGGGC
```
_____

```
AGTACTCGTGCTCAACAATCGCGTAATCGGCGAAGGTTGGAATAGGGCAATCGGACTCCACG
```
_____

```
ACCCCACTGCACATGCGGAAATCATGGCCCTTCGACAGGGAGGGCTTGTGATGCAGAATTAT
```
_____

-continued

CGACTTTATGATGCGACGCTGTACGTCACGTTTGAACCTTGCGTAATGTGCGCGGGAGCTAT

GATTCACTCCCGCATTGGACGAGTTGTATTCGGTGTTCGCAACGCCAAGACGGGTGCCGCAG

GTTCACTGATGGACGTGCTGCATCATCCAGGCATGAACCACCGGGTAGAAATCACAGAAGGC

ATATTGGCGGACGAATGTGCGGCGCTGTTGTGTCGTTTTTTTCGCATGCCCAGGCGGGTCTT

TAACGCCCAGAAAAAAGCACAATCCTCTACTGACGGCTCTTCTGGATCTGAAACACCTGGCA

CAAGCGAGAGCGCCACCCCTGAGAGCTCTGGCCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATGAAAAGGCCGGCGGC

CACGAAAAGGCCGGCCAGGCAAAAAAGAAAAAGGGATCCTACCCATACGATGTTCCAGATT

ACGCTTATCCCTACGACGTGCCTGATTATGCATACCCATATGATGTCCCCGACTATGCCTAA (SEQ ID NO: 235)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDENEPSEKYLEVFKDYQRKHPREAGDYSVYEFLSKKENHFIWRNHPEYPY

LYATFCEIDKKKKDAKQQATFTLADPINHPLWVRFEERSGSNLNKYRILTEQLHTEKLKKKL

TVQLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKVVNFKP

KELTEWIKDSKGKKLKSGIESLEIGLRVMSIDLGQRQAAAASIFEVVDQKPDIEGKLFFPIK

GTELYAVHRASFNIKLPGETLVKSREVLRKAREDNLKLMNQKLNFLRNVLHFQQFEDITERE

KRVTKWISRQENSDVPLVYQDELIQIRELMYKPYKDWVAFLKQLHKRLEVEIGKEVKHWRKS

LSDGRKGLYGISLKNIDEIDRTRKFLLRWSLRPTEPGEVRRLEPGQRFAIDQLNHLNALKED

RLKKMANTIIMHALGYCYDVRKKKWQAKNPACQIILFEDLSNYNPYEERSRFENSKLMKWSR

REIPRQVALQGEIYGLQVGEVGAQFSSRFHAKTGSPGIRCSVVTKEKLQDNRFFKNLQREGR

LTLDKIAVLKEGDLYPDKGGEKFISLSKDRKCVTTHADINAAQNLQKRFWTRTHGFYKVYCK

AYQVDGQTVYIPESKDQKQKIIEEFGEGYFILKDGVYEWVNAGKGGSGGSSEVEFSHEYWMR

HALTLAKRARDEREVPVGAVLVLNNRVIGEGWNRAIGLHDPTAHAEIMALRQGGLVMQNYRL

YDATLYVTFEPCVMCAGAMIHSRIGRVVFGVRNAKTGAAGSLMDVLHHPGMNHRVEITEGIL

ADECAALLCRFFRMPRRVFNAQKKAQSSTDGSSGSETPGTSESATPESSGLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA

For the sequences above, the Kozak sequence is bolded and underlined; marks the N-terminal nuclear localization signal (NLS); lower case characters denote the GGGSGGS linker (SEQ ID NO: 236); _____, marks the sequence encoding ABE8, unmodified sequence encodes BhCas12b; double underling denotes the Xten20 linker; single underlining denotes the C-terminal NLS; GGATCC denotes the GS linker; and italicized characters represent the coding sequence of the 3× hemagglutinin (HA) tag.

Guide Polynucleotides

In an embodiment, the guide polynucleotide is a guide RNA. An RNA/Cas complex can assist in "guiding" Cas protein to a target DNA. Cas9/crRNA/tracrRNA endonucle-olytically cleaves linear or circular dsDNA target comple-mentary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gRNA") can be engi-neered so as to incorporate aspects of both the crRNA and tracrRNA into a single RNA species. See, e.g., Jinek M. et al., Science 337:816-821(2012), the entire contents of which is hereby incorporated by reference. Cas9 recognizes a short motif in the CRISPR repeat sequences (the PAM or proto-spacer adjacent motif) to help distinguish self versus non-self. Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663 (2001); "CRISPR RNA maturation by trans-encoded small RNA and host factor RNase III." Deltcheva E. et al., Nature 471:602-607(2011); and "Programmable dual-RNA-guided DNA endonuclease in adaptive bacterial immunity." Jinek M. et al, Science 337:816-821(2012), the entire contents of each of which are incorporated herein by reference). Cas9 orthologs have been described in various species, including, but not limited to, *S. pyogenes* and *S. thermophilus*. Addi-tional suitable Cas9 nucleases and sequences can be appar-ent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gRNA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. In some embodiments, the guide polynucleotide comprises natural nucleotides (e.g., adenosine). In some embodiments, the guide polynucleotide comprises non-natural (or unnatural) nucleotides (e.g., pep-tide nucleic acid or nucleotide analogs). In some embodi-ments, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, a guide polynucleotide comprises two or more individual polynucleotides, which can interact with one another via for example complementary base pairing (e.g., a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g., Cas9) typically requires comple-mentary base pairing between a first RNA molecule (crRNA) comprising a sequence that recognizes the target sequence and a second RNA molecule (trRNA) comprising repeat sequences which forms a scaffold region that stabi-lizes the guide RNA-CRISPR protein complex. Such dual guide RNA systems can be employed as a guide polynucle-otide to direct the base editors disclosed herein to a target polynucleotide sequence.

In some embodiments, the base editor provided herein utilizes a single guide polynucleotide (e.g., gRNA). In some embodiments, the base editor provided herein utilizes a dual guide polynucleotide (e.g., dual gRNAs). In some embodi-ments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In other embodiments, a guide polynucleotide can com-prise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide poly-nucleotide within a polynucleotide programmable nucleo-tide binding domain component of a base editor. In some embodiments, the polynucleotide targeting segment of the guide polynucleotide recognizes and binds to a DNA poly-nucleotide, thereby facilitating the editing of a base in DNA. In other embodiments, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid mol-ecules, the protein-binding segment of can include all or a portion of multiple separate molecules that are for instance hybridized along a region of complementarity. In some embodiments, a protein-binding segment of a DNA-target-ing RNA that comprises two separate molecules can com-prise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some embodiments, a first region of a guide RNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides; or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some embodiments, a guide can target exon 1 or 2 of a gene; in other embodiments, a guide can target exon 3 or 4 of a gene. A composition can comprise multiple guide RNAs that all target the same exon or in some embodiments, multiple guide RNAs that can target different exons. An exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, a RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III). Plasmid vectors that can be used to express guide RNA include, but are not limited to, px330 vectors and px333 vectors. In some embodiments, a plasmid vector (e.g., px333 vector) can comprise at least two guide RNA-encoding DNA sequences.

Methods for selecting, designing, and validating guide polynucleotides, e.g., guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g., a target gene may be obtained and repeat elements may be screened using publicly available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g., crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g., a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

The guide polynucleotides can be synthesized chemically, synthesized enzymatically, or a combination thereof. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g., gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. The multiple gRNA sequences can be tandemly arranged and are preferably separated by a direct repeat.

A DNA sequence encoding a guide RNA or a guide polynucleotide can also be part of a vector. Further, a vector can comprise additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a guide RNA can also be linear. A DNA molecule encoding a guide RNA or a guide polynucleotide can also be circular.

In some embodiments, one or more components of a base editor system may be encoded by DNA sequences. Such DNA sequences may be introduced into an expression system, e.g., a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some embodiments, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some embodiments, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5'adenylate, 5' guanosine-triphosphate cap, 5'N7-Methylguanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some embodiments, a modification is permanent. In other embodiments, a modification is transient. In some embodiments, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR(N), TTTV, TYCV, TYCV, TATV, NNNNGATT, NNAGAAW, or NAAAAC. Y is a pyrimidine; N is any nucleotide base; W is A or T.

A modification can also be a phosphorothioate substitute. In some embodiments, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some embodiments, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or "-end of a gRNA which can inhibit exonuclease degradation. In some embodiments, phosphorothioate bonds can be added throughout an entire gRNA to reduce attack by endonucleases.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities.

For example, typically Cas9 proteins, such as Cas9 from S. pyogenes (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 4 below.

TABLE 4

| Cas9 proteins and corresponding PAM sequences | |
|---|---|
| Variant | PAM |
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |

TABLE 4-continued

| Cas9 proteins and corresponding PAM sequences | |
|---|---|
| Variant | PAM |
| spCas9-MQKFRAER | NGC |
| Cpf1 | 5' (TTTV) |
| SpyMac | 5'-NAA-3' |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the PAM is NGT. In some embodiments, the NGT PAM is recognized by a Cas9 variant. In some embodiments, the NGT PAM variant is generated through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 5A and 5B below.

TABLE 5A

| | NGT PAM Variant Mutations at residues 1219, 1335, 1337, 1218 | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 5B

| | NGT PAM Variant Mutations at residues 1135, 1136, 1218, 1219, and 1335 | | | | |
|---|---|---|---|---|---|
| Variant | D1135L | S1136R | G1218S | E1219V | R1335Q |
| 27 | G | | | | |
| 28 | V | | | | |

TABLE 5B-continued

| | NGT PAM Variant Mutations at residues 1135, 1136, 1218, 1219, and 1335 | | | | |
|---|---|---|---|---|---|
| Variant | D1135L | S1136R | G1218S | E1219V | R1335Q |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 6 below.

TABLE 6

| | NGT PAM Variant Mutations at residues 1219, 1335, 1337, and 1218 | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D10X mutation, or a corresponding mutation in any of the amino acid sequences provided herein, wherein X is any amino acid except for D. In some embodiments, the SpCas9 comprises a D10A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135E, R1335Q, and T1337R mutation, or a corresponding mutation in any of the amino acid sequences provided herein. In some embodiments, the SpCas9 domain comprises a D1135E, a R1335Q, and a T1337R mutation, or corresponding mutations in any of the amino acid sequences provided herein. In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135V, a R1335Q, and a T1337R mutation, or a corresponding mutation in any of the amino acid sequences provided herein. In some embodiments, the SpCas9 domain comprises a D1135V, a R1335Q, and a T1337R mutation, or corresponding mutations in any of the amino acid sequences provided herein. In some embodiments, the SpCas9 domain comprises one or more of a D1135X, a G1218X, a R1335X, and a T1337X mutation, or a corresponding mutation in any of the amino acid sequences provided herein, wherein X is any amino acid. In some embodiments, the SpCas9 domain comprises one or more of a D1135V, a G1218R, a R1335Q, and a T1337R mutation, or a corresponding mutation in any of the amino acid sequences provided herein. In some embodiments, the SpCas9 domain comprises a D1135V, a G1218R, a R1335Q, and a T1337R mutation, or corresponding mutations in any of the amino acid sequences provided herein.

In some embodiments, the Cas9 is a Cas9 variant having specificity for an altered PAM sequence. In some embodiments, the Additional Cas9 variants and PAM sequences are described in Miller et al., Continuous evolution of SpCas9 variants compatible with non-G PAMs, Nat Biotechnol (2020), doi: 10.1038/s41587-020-0412-8, the entirety of which is incorporated herein by reference. in some embodiments, a Cas9 variate have no specific PAM requirements. In some embodiments, a Cas9 variant, e.g. a SpCas9 variant has specificity for a NRNH PAM, wherein R is A or G and H is A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 as numbered in SEQ ID NO: 1 or a corresponding position thereof. In some embodiments, the SpCas9 variant comprises an amino acid substitution at position 1114, 1135, 1218, 1219, 1221, 1249, 1320, 1321, 1323, 1332, 1333, 1335, or 1337 as numbered in SEQ ID NO: 1 or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 as numbered in SEQ ID NO: 1 or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 as numbered in SEQ ID NO: 1 or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 as numbered in SEQ ID NO: 1 or a corresponding position thereof.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, S. pyogenes Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kb coding sequence) can lead to plasmids carrying the SpCas9 cDNA that cannot be efficiently expressed in a cell. Conversely, the coding sequence for Staphylococcus aureus Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of S. thermophilus (5'-NNAGAA for CRISPR1 and 5'-NGGNG for CRISPR3) and Neisseria meningiditis (5'-NNNNGATT) can also be found adjacent to a target gene.

In some embodiments, for a S. pyogenes system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

(SEQ ID NO: 8)
MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD

The amino acid sequence of an exemplary PAM-binding SpCas9n is as follows:

(SEQ ID NO: 25)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

-continued
GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD

The amino acid sequence of an exemplary PAM-binding SpEQR Cas9 is as follows:

(SEQ ID NO: 237)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESVLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

-continued

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFESPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKQYRSTKEVLDATLIHQSITGLYETRIDLSQLGGD

In the above sequence, residues E1134, Q1334, and R1336, which can be mutated from D1134, R1335, and T1336 to yield a SpEQR Cas9, are underlined and in bold.

The amino acid sequence of an exemplary PAM-binding SpVQR Cas9 is as follows:

(SEQ ID NO: 238)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFVSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

-continued

FSKRVILADANLDKVLSAYNKHRDKPIREQAENIIHLFTLTNLGAPAAFKY

FDTTIDRKQYRSTKEVLDATLIHQSITGLYETRIDLSQLGGD

In the above sequence, residues V1134, Q1334, and R1336, which can be mutated from D1134, R1335, and T1336 to yield a SpVQR Cas9, are underlined and in bold.

The amino acid sequence of an exemplary PAM-binding SpVRER Cas9 is as follows:

(SEQ ID NO: 239)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFVSPTVAYSVLVVAKVEKGKSKKLKSVKELLGITIMERSS

FEKNPIDFLEAKGYKEVKKDLIIKLPKYSLFELENGRKRMLASARELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKEYRSTKEVLDATLIHQSITGLYETRIDLSQLGGD.

In the above sequence, residues V1134, R1217, Q1334, and R1336, which can be mutated from D1134, G1217, R1335, and T1336 to yield a SpVRER Cas9, are underlined and in bold.

Figure 10:
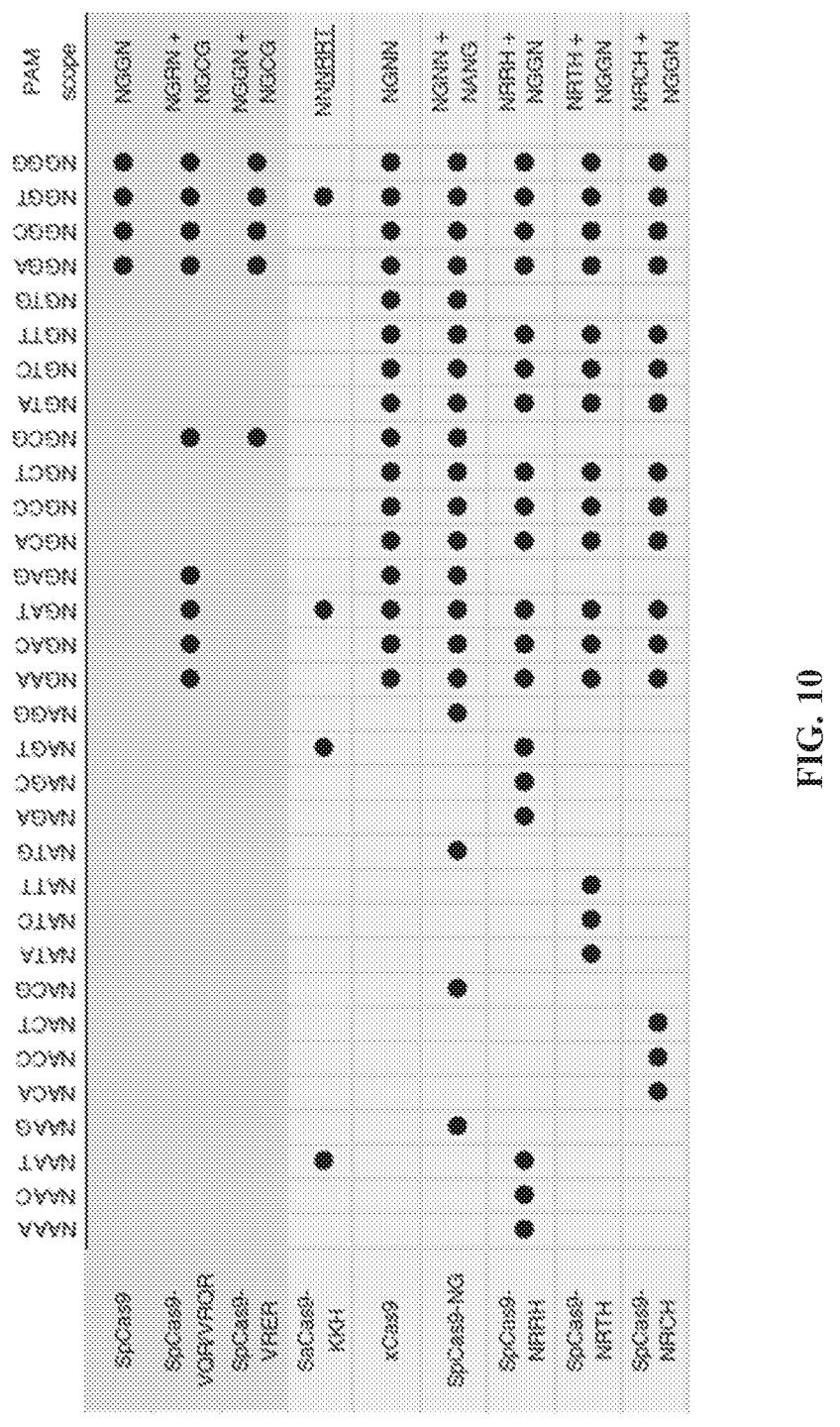

In some embodiments, engineered SpCas9 variants are capable of recognizing protospacer adjacent motif (PAM) sequences flanked by a 3' H (non-G PAM) (see Tables 3A-3D; FIG. 10). In some embodiments, the SpCas9 variants recognize NRNH PAMs (where R is A or G and H is A, C or T). In some embodiments, the non-G PAM is NRRH, NRTH, or NRCH (see e.g., Miller, S. M., et al. Continuous evolution of SpCas9 variants compatible with non-G PAMs, Nat. Biotechnol. (2020), the contents of which is incorporated herein by reference in its entirety).

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a Spy-MacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMac-Cas9 domain, the SpCas9d domain, or the SpCas9n domain can bind to a nucleic acid sequence having a NAA PAM sequence.

The sequence of an exemplary Cas9 A homolog of Spy Cas9 in *Streptococcus macacae* with native 5'-NAAN-3' PAM specificity is known in the art and described, for example, by Jakimo et al., (biorxiv, 2018/09/27, 429654), and is provided below.

```
SpyMacCas9
                                    (SEQ ID NO: 240)
MDKKYSIGLDIGTNSVGWAVITDDYKVPSKKFKVLGNTDRHSIKKNLIGAL

LFGSGETAEATRLKRTARRRYTRRKNRICYLQEIFSNEMAKVDDSFFHRLE

ESFLVEEDKKHERHPIFGNIVDEVAYHEKYPTIYHLRKKLADSTDKADLRL

IYLALAHMIKFRGHFLIEGDLNPDNSDVDKLFIQLVQIYNQLFEENPINAS

RVDAKAILSARLSKSRRLENLIAQLPGEKRNGLFGNLIALSLGLTPNFKSN

FDLAEDAKLQLSKDTYDDDLDNLLAQIGDQYADLFLAAKNLSDAILLSDIL

RVNSEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGAYHDLLKIIKDKDFLDNEEN

EDILEDIVLTLTLFEDRGMIEERLKTYAHLFDDKVMKQLKRRRYTGWGRLS

RKLINGIRDKQSGKTILDFLKSDGFANRNFMQLIHDDSLTFKEDIQKAQVS

GQGHSLHEQIANLAGSPAIKKGILQTVKIVDELVKVMGHKPENIVIEMARE

NQTTQKGQKNSRERMKRIEEGIKELGSQILKEHPVENTQLQNEKLYLYYLQ

NGRDMYVDQELDINRLSDYDVDHIVPQSFIKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEIQTVGQNGGLFDDNPKSPLEVTPS

KLVPLKKELNPKKYGGYQKPTTAYPVLLITDTKQLIPISVMNKKQFEQNPV

KFLRDRGYQQVGKNDFIKLPKYTLVDIGDGIKRLWASSKEIHKGNQLVVSK

KSQILLYHAHHLDSDLSNDYLQNHNQQFDVLFNEIISFSKKCKLGKEHIQK

IENVYSNKKNSASIEELAESFIKLLGFTQLGATSPFNFLGVKLNQKQYKGK

KDYILPCTEGTLIRQSITGLYETRVDLSKIGED.
```

In some embodiments, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Klein-stiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

Cas9 Domains with Reduced PAM Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" Nature 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild-type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

In some embodiments, the modified Cas9 is a high fidelity Cas9 enzyme. In some embodiments, the high fidelity Cas9 enzyme is SpCas9(K855A), eSpCas9(1.1), SpCas9-HF1, or hyper accurate Cas9 variant (HypaCas9). The modified Cas9 eSpCas9(1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9.

An exemplary high fidelity Cas9 is provided below. High Fidelity Cas9 domain mutations relative to Cas9 are shown in bold and underlined.

(SEQ ID NO: 241)

```
DKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEE

SFLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINASG

VDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILR

VNTEITKAPLSASMIKRYDEHHQDLTLLKALVRQQLPEKYKEIFFDQSKNG

YAGYIDGGASQEEFYKFIKPILEKMDGTEELLVKLNREDLLRKQRTFDNGS

IPHQIHLGELHAILRRQEDFYPFLKDNREKIEKILTFRIPYYVGPLARGNS

RFAWMTRKSEETITPWNFEEVVDKGASAQSFIERMTAFDKNLPNEKVLPKH

SLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENE

DILEDIVLTLTLFEDREMIEERLKTYAHLFDDKVMKQLKRRRYTGWGALSR

KLINGIRDKQSGKTILDFLKSDGFANRNFMALIHDDSLTFKEDIQKAQVSG

QGDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKR

QLVETRAITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARK

KDWDPKKYGGFDSPTVAYSVLVVAKVEKGKSKKLKSVKELLGITIMERSSF

EKNPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKYF

DTTIDRKRYTSTKEVLDATLIHQSITGLYETRIDLSQLGGD
```

Fusion Proteins Comprising a Cas9 Domain and a Cytidine Deaminase or Adenosine Deaminase Some aspects of the disclosure provide fusion proteins comprising a napDNAbp (e.g. a Cas9 domain) and one or more adenosine deaminase domains. In some embodiments, the fusion protein comprises a Cas9 domain and an adenosine deaminase domain (e.g., TadA*A).

It should be appreciated that the Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases (e.g., TadA*A) provided herein. For example, and without limitation, in some embodiments, the fusion protein comprises the structure:

NH$_2$-[adenosine deaminase]-[Cas9 domain]-COOH; or
NH$_2$-[Cas9 domain]-[adenosine deaminase]-COOH.

In some embodiments, the fusion proteins comprising an adenosine deaminase and a napDNAbp (e.g., Cas9 domain) do not include a linker sequence. In some embodiments, a linker is present between the adenosine deaminase and the napDNAbp. In some embodiments, the "-" used in the general architecture above indicates the presence of an optional linker. In some embodiments, cytidine or adenosine deaminase and the napDNAbp are fused via any of the linkers provided herein. For example, in some embodiments the adenosine deaminase and the napDNAbp are fused via any of the linkers provided herein.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFESPKKKRKV (SEQ ID NO: 242), KRTADGSEFESPKKKRKV (SEQ ID NO: 74), KRPAATKKAGQAKKKK (SEQ ID NO: 75), KKTELQTTNAENKTKKL (SEQ ID NO: 76), KRGIN-DRNFWRGENGRKTR (SEQ ID NO: 77), RKSGKIAAIV-VKRPRKPKKKRKV (SEQ ID NO: 243), or MDSLL-MNRRKFLYQFKNVRWAKGRRETYLC (SEQ ID NO: 80).

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 75), is the prototype of the ubiquitous bipartite signal: two clusters of basic amino acids, separated by a spacer of about 10 amino acids. The sequence of an exemplary bipartite NLS follows:

(SEQ ID NO: 242)
PKKKRKVEGADKRTADGSEFESPKKKRKV

In some embodiments, the fusion proteins comprising an adenosine deaminase, a napDNAbp (e.g., a Cas9 domain), and an NLS do not comprise a linker sequence. In some embodiments, linker sequences between one or more of the domains or proteins (e.g., adenosine deaminase, Cas9 domain or NLS) are present. In some embodiments, the general architecture of exemplary Cas9 fusion proteins with an adenosine deaminase and a Cas9 domain comprises any one of the following structures, where NLS is a nuclear localization sequence (e.g., any NLS provided herein), $NH_2$ is the N-terminus of the fusion protein, and COOH is the C-terminus of the fusion protein:

$NH_2$-NLS-[adenosine deaminase]-[Cas9 domain]-COOH;

$NH_2$-NLS [Cas9 domain]-[adenosine deaminase]-COOH;

$NH_2$-[adenosine deaminase]-[Cas9 domain]-NLS—COOH; or $NH_2$-[Cas9 domain]-[adenosine deaminase]-NLS—COOH.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the ammo-terminus, about or more than about 1, 2, 3, 4, 5, 6, 7, 8, 9, 10 NLSs at or near the carboxy-terminus, or any combination of these (e.g., one or more NLS at the ammo-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Nucleobase Editing Domain

Described herein are base editors comprising a fusion protein that includes a polynucleotide programmable nucleotide binding domain and a nucleobase editing domain (e.g., a deaminase domain). The base editor can be programmed to edit one or more bases in a target polynucleotide sequence by interacting with a guide polynucleotide capable of recognizing the target sequence. Once the target sequence has been recognized, the base editor is anchored on the polynucleotide where editing is to occur and the deaminase domain components of the base editor can then edit a target base.

In some embodiments, the nucleobase editing domain includes a deaminase domain. As particularly described herein, the deaminase domain includes a cytosine deaminase or an adenosine deaminase. In some embodiments, the terms "cytosine deaminase" and "cytidine deaminase" can be used interchangeably. In some embodiments, the terms "adenine deaminase" and "adenosine deaminase" can be used interchangeably. Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A to G Editing

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2). In another embodiment, an adenosine deaminase incorporated into a base editor comprises all or a portion of adenosine deaminase acting on tRNA (ADAT). A base editor comprising an adenosine deaminase domain can also be capable of deaminating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from *Escherichia coli* (EcTadA) comprising one or more of the following mutations: D108N, A106V, D147Y, E155V, L84F, H123Y, I156F, or a corresponding mutation in another adenosine deaminase.

The adenosine deaminase can be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that corresponds to any of the mutations described herein (e.g., any of the mutations identified in ecTadA) can be generated accordingly.

Adenosine Deaminases

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the adenosine deaminases provided herein are capable of deaminating adenine. In some embodiments, the adenosine deaminases provided herein are capable of deaminating adenine in a deoxyadenosine residue of DNA. In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

The invention provides adenosine deaminase variants that have increased efficiency (>50-60%) and specificity. In particular, the adenosine deaminase variants described herein are more likely to edit a desired base within a polynucleotide, and are less likely to edit bases that are not intended to be altered (i.e., "bystanders").

In particular embodiments, the TadA is any one of the TadA described in PCT/US2017/045381 (WO 2018/027078), which is incorporated herein by reference in its entirety.

In some embodiments, the nucleobase editors of the invention are adenosine deaminase variants comprising an alteration in the following sequence:

```
                                    (SEQ ID NO: 3)
MSEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGRV

VFGVRNAKTGAAGSLMDVLHYPGMNHRVEITEGILADECAALLCYFFRMPR

QVFNAQKKAQSSTD (also termed TadA*7.10).
```

In particular embodiments, the fusion proteins comprise a single (e.g., provided as a monomer) TadA*8 variant. In some embodiments, the TadA*8 is linked to a Cas9 nickase. In some embodiments, the fusion proteins of the invention comprise as a heterodimer of a wild-type TadA (TadA(wt)) linked to a TadA*8 variant. In other embodiments, the fusion proteins of the invention comprise as a heterodimer of a TadA*7.10 linked to a TadA*8 variant. In some embodiments, the base editor is ABE8 comprising a TadA*8 variant monomer. In some embodiments, the base editor is ABE8 comprising a heterodimer of a TadA*8 variant and a TadA (wt). In some embodiments, the base editor is ABE8 comprising a heterodimer of a TadA*8 variant and TadA*7.10. In some embodiments, the base editor is ABE8 comprising a heterodimer of a TadA*8 variant. In some embodiments, the TadA*8 variant is selected from Table 9. In some embodiments, the ABE8 is selected from Table 8, 9, 10, or 11. The relevant sequences follow:

```
Wild-type TadA (TadA(wt)) or "the TadA reference
sequence"
                                    (SEQ ID NO: 2)
MSEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGRV

VFGARDAKTGAAGSLMDVLHHPGMNHRVEITEGILADECAALLSDFFRMRR

QEIKAQKKAQSSTD

TadA*7.10:
                                    (SEQ ID NO: 3)
MSEVEFSHEYW MRHALTLAKR ARDEREVPVG AVLVLNNRVI

GEGWNRAIGL HDPTAHAEIM ALRQGGLVMQ NYRLIDATLY

VTFEPCVMCA GAMIHSRIGR VVFGVRNAKT GAAGSLMDVL

HYPGMNHRVE ITEGILADEC AALLCYFFRM PRQVFNAQKK AQSSTD
```

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments the TadA deaminase is a full-length E. coli TadA deaminase. For example, in certain embodiments, the adenosine deaminase comprises the amino acid sequence:

```
                                    (SEQ ID NO: 244)
MRRAFITGVFFLSEVEFSHEYWMRHALTLAKRAWDEREVPVGAVLVHNNRV

IGEGWNRPIGRHDPTAHAEIMALRQGGLVMQNYRLIDATLYVTLEPCVMCA

GAMIHSRIGRVVFGARDAKTGAAGSLMDVLHHPGMNHRVEITEGILADECA

ALLSDFFRMRRQEIKAQKKAQSSTD.
```

It should be appreciated, however, that additional adenosine deaminases useful in the present application would be apparent to the skilled artisan and are within the scope of this disclosure. For example, the adenosine deaminase may be a homolog of adenosine deaminase acting on tRNA (ADAT). Without limitation, the amino acid sequences of exemplary AD AT homologs include the following:

```
Staphylococcus aureus TadA:
                                    (SEQ ID NO: 10)
MGSHMTNDIYFMTLAIEEAKKAAQLGEVPIGAIITKDDEVIARAHNLRETL

QQPTAHAEHIAIERAAKVLGSWRLEGCTLYVTLEPCVMCAGTIVMSRIPRV

VYGADDPKGGCSGSLMNLLQQSNFNHRAIVDKGVLKEACSTLLTTFFKNLR

ANKKSTN

Bacillus subtilis TadA:
                                    (SEQ ID NO: 11)
MTQDELYMKEAIKEAKKAEEKGEVPIGAVLVINGEIIARAHNLRETEQRSI

AHAEMLVIDEACKALGTWRLEGATLYVTLEPCPMCAGAVVLSRVEKVVFGA

FDPKGGCSGTLMNLLQEERFNHQAEVVSGVLEEECGGMLSAFFRELRKKKK

AARKNLSE

Salmonella typhimurium (S. typhimurium) TadA:
                                    (SEQ ID NO: 12)
MPPAFITGVTSLSDVELDHEYWMRHALTLAKRAWDEREVPVGAVLVHNHRV

IGEGWNRPIGRHDPTAHAEIMALRQGGLVLQNYRLLDTTLYVTLEPCVMCA

GAMVHSRIGRVVFGARDAKTGAAGSLIDVLHHPGMNHRVEIIEGVLRDECA

TLLSDFFRMRRQEIKALKKADRAEGAGPAV

Shewanella putrefaciens (S. putrefaciens) TadA:
                                    (SEQ ID NO: 13)
MDEYWMQVAMQMAEKAEAAGEVPVGAVLVKDGQQIATGYNLSISQHDPTAH

AEILCLRSAGKKLENYRLLDATLYITLEPCAMCAGAMVHSRIARVVYGARD
```

-continued

```
EKTGAAGTVVNLLQHPAFNHQVEVTSGVLAEACSAQLSRFFKRRRDEKKAL

KLAQRAQQGIE
```

Haemophilus influenzae F3031 (H. influenzae) TadA:
```
                                        (SEQ ID NO: 14)
MDAAKVRSEFDEKMMRYALELADKAEALGEIPVGAVLVDDDARNIIGEGWNL

SIVQSDPTAHAEIIALRNGAKNIQNYRLLNSTLYVTLEPCTMCAGAILHSR

IKRLVFGASDYKTGAIGSRFHFFDDYKMNHTLEITSGVLAEECSQKLSTFF

QKRREEKKIEKALLKSLSDK
```

Caulobacter crescentus (C. crescentus) TadA:
```
                                        (SEQ ID NO: 15)
MRTDESEDQDHRMMRLALDAARAAAEAGETPVGAVILDPSTGEVIATAGNG

PIAAHDPTAHAEIAAMRAAAAKLGNYRLTDLTLVVTLEPCAMCAGAISHAR

IGRVVFGADDPKGGAVVHGPKFFAQPTCHWRPEVTGGVLADESADLLRGFF

RARRKAKI
```

Geobacter sulfurreducens (G. sulfurreducens) TadA:
```
                                        (SEQ ID NO: 16)
MSSLKKTPIRDDAYWMGKAIREAAKAAARDEVPIGAVIVRDGAVIGRGHNL

REGSNDPSAHAEMIAIRQAARRSANWRLTGATLYVTLEPCLMCMGAIILAR

LERVVFGCYDPKGGAAGSLYDLSADPRLNHQVRLSPGVCQEECGTMLSDFF

RDLRRRKKAKATPALFIDERKVPPEP
```

An embodiment of E. Coli TadA (ecTadA) includes the following:

```
                                        (SEQ ID NO: 245)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD
```

In some embodiments, the adenosine deaminase is from a prokaryote. In some embodiments, the adenosine deaminase is from a bacterium. In some embodiments, the adenosine deaminase is from Escherichia coli, Staphylococcus aureus, Salmonella typhi, Shewanella putrefaciens, Haemophilus influenzae, Caulobacter crescentus, or Bacillus subtilis. In some embodiments, the adenosine deaminase is from E. coli.

In one embodiment, a fusion protein of the invention comprises a wild-type TadA linked to TadA*7.10, which is linked to Cas9 nickase. In particular embodiments, the fusion proteins comprise a single TadA*7.10 domain (e.g., provided as a monomer). In other embodiments, the ABE7.10 editor comprises TadA*7.10 and TadA(wt), which are capable of forming heterodimers.

It should be appreciated that any of the mutations provided herein (e.g., based on the TadA reference sequence) can be introduced into other adenosine deaminases, such as E. coli TadA (ecTadA), S. aureus TadA (saTadA), or other adenosine deaminases (e.g., bacterial adenosine deaminases). It would be apparent to the skilled artisan that additional deaminases may similarly be aligned to identify homologous amino acid residues that can be mutated as provided herein. Thus, any of the mutations identified in the TadA reference sequence can be made in other adenosine deaminases (e.g., ecTada) that have homologous amino acid residues. It should also be appreciated that any of the mutations provided herein can be made individually or in any combination in the TadA reference sequence or another adenosine deaminase.

In some embodiments, the adenosine deaminase comprises a D108X mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a D108G, D108N, D108V, D108A, or D108Y mutation, or a corresponding mutation in another adenosine deaminase.

In some embodiments, the adenosine deaminase comprises an A106X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase (e.g., wild-type TadA or ecTadA).

In some embodiments, the adenosine deaminase comprises a E155X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase (e.g., ecTadA).

In some embodiments, the adenosine deaminase comprises a D147X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase (e.g., ecTadA).

In some embodiments, the adenosine deaminase comprises an A106X, E155X, or D147X, mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

For example, an adenosine deaminase can contain a D108N, a A106V, a E155V, and/or a D147Y mutation in TadA reference sequence, or a corresponding mutation in another adenosine deaminase (e.g., ecTadA). In some embodiments, an adenosine deaminase comprises the following group of mutations (groups of mutations are separated by a ";") in TadA reference sequence, or corresponding mutations in another adenosine deaminase (e.g., ecTadA): D108N and A106V; D108N and E155V; D108N and D147Y; A106V and E155V; A106V and D147Y; E155V and D147Y; D108N, A106V, and E155V; D108N, A106V, and D147Y; D108N, E155V, and D147Y; A106V, E155V, and D147Y; and D108N, A106V, E155V, and D147Y. It should be appreciated, however, that any combination of corresponding mutations provided herein can be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95L, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in TadA reference sequence, or one or more corresponding mutations in another adenosine deaminase (e.g., ecTadA).

In some embodiments, the adenosine deaminase comprises one or more of a H8X, D108X, and/or N127X mutation in TadA reference sequence, or one or more corresponding mutations in another adenosine deaminase (e.g., ecTadA), where X indicates the presence of any amino acid. In some embodiments, the adenosine deaminase comprises one or more of a H8Y, D108N, and/or N127S mutation in TadA reference sequence, or one or more corresponding mutations in another adenosine deaminase (e.g., ecTadA).

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase (e.g., ecTadA), where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase (e.g., ecTadA).

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R26X, L68X, D108X, N127X, D147X, and E155X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase (e.g., ecTadA). In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, R26W, L68Q, D108N, N127S, D147Y, and E155V in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase (e.g., ecTadA).

Any of the mutations provided herein and any additional mutations (e.g., based on the ecTadA amino acid sequence) can be introduced into any other adenosine deaminases. Any of the mutations provided herein can be made individually or in any combination in TadA reference sequence or another adenosine deaminase (e.g., ecTadA).

Details of A to G nucleobase editing proteins are described in International PCT Application No. PCT/2017/045381 (WO2018/027078) and Gaudelli, N. M., et al., "Programmable base editing of A•T to G•C in genomic DNA without DNA cleavage" Nature, 551, 464-471 (2017), the entire contents of which are hereby incorporated by reference.

In some embodiments, the adenosine deaminase comprises one or more corresponding mutations in another adenosine deaminase (e.g., ecTadA). In some embodiments, the adenosine deaminase comprises a D108N, D108G, or D108V mutation in TadA reference sequence, or corresponding mutations in another adenosine deaminase (e.g., ecTadA). In some embodiments, the adenosine deaminase comprises a A106V and D108N mutation in TadA reference sequence, or corresponding mutations in another adenosine deaminase (e.g., ecTadA). In some embodiments, the adenosine deaminase comprises R107C and D108N mutations in TadA reference sequence, or corresponding mutations in another adenosine deaminase (e.g., ecTadA). In some embodiments, the adenosine deaminase comprises a H8Y, D108N, N127S, D147Y, and Q154H mutation in TadA reference sequence, or corresponding mutations in another adenosine deaminase (e.g., ecTadA). In some embodiments, the adenosine deaminase comprises a H8Y, D108N, N127S, D147Y, and E155V mutation in TadA reference sequence, or corresponding mutations in another adenosine deaminase (e.g., ecTadA). In some embodiments, the adenosine deaminase comprises a D108N, D147Y, and E155V mutation in TadA reference sequence, or corresponding mutations in another adenosine deaminase (e.g., ecTadA). In some embodiments, the adenosine deaminase comprises a H8Y, D108N, and N127S mutation in TadA reference sequence, or corresponding mutations in another adenosine deaminase (e.g., ecTadA). In some embodiments, the adenosine deaminase comprises a A106V, D108N, D147Y and E155V mutation in TadA reference sequence, or corresponding mutations in another adenosine deaminase (e.g., ecTadA).

In some embodiments, the adenosine deaminase comprises one or more of a S2X, H8X, I49X, L84X, H123X, N127X, I156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in TadA reference sequence, or one or more corresponding mutations in another adenosine deaminase (e.g., ecTadA).

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase (e.g., ecTadA).

In some embodiments, the adenosine deaminase comprises an H123X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase (e.g., ecTadA).

In some embodiments, the adenosine deaminase comprises an I156X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an I156F mutation in TadA reference sequence, or a corresponding mutation in another adenosine deaminase (e.g., ecTadA).

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase (e.g., ecTadA). In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase (e.g., ecTadA).

In some embodiments, the adenosine deaminase comprises one or more of a E25X, R26X, R107X, A142X, and/or A143X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R107K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase (e.g., ecTadA). In some embodiments, the adenosine deaminase comprises one or more of the mutations described herein corresponding to TadA reference sequence, or one or more corresponding mutations in another adenosine deaminase (e.g., ecTadA).

In some embodiments, the adenosine deaminase comprises an E25X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase (e.g., ecTadA).

In some embodiments, the adenosine deaminase comprises an R26X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase (e.g., ecTadA).

In some embodiments, the adenosine deaminase comprises an R107X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an R107P, R107K, R107A, R107N, R107W, R107H, or R107S mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase (e.g., ecTadA).

In some embodiments, the adenosine deaminase comprises an A143X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase (e.g., ecTadA).

In some embodiments, the adenosine deaminase comprises one or more of a H36X, N37X, P48X, I49X, R51X, M70X, N72X, D77X, E134X, S146X, Q154X, K157X, and/or K161X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in TadA reference sequence, or one or more corresponding mutations in another adenosine deaminase (e.g., ecTadA).

In some embodiments, the adenosine deaminase comprises an H36X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase (e.g., ecTadA).

In some embodiments, the adenosine deaminase comprises an N37X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase (e.g., ecTadA).

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase (e.g., ecTadA).

In some embodiments, the adenosine deaminase comprises an S146X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an S146R, or S146C mutation in TadA reference sequence, or a corresponding mutation in another adenosine deaminase (e.g., ecTadA).

In some embodiments, the adenosine deaminase comprises an K157X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase (e.g., ecTadA).

In some embodiments, the adenosine deaminase comprises an W23X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase (e.g., ecTadA).

In some embodiments, the adenosine deaminase comprises an R152X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase (e.g., ecTadA).

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses:

(A106V_D108N),
(R107C_D108N),
(H8Y_D108N_N127S_D147Y_Q154H),
(H8Y_D108N_N127S_D147Y_E155V),
(D108N_D147Y_E155V),
(H8Y_D108N_N127S),
(H8Y_D108N_N127S_D147Y_Q154H),
(A106V_D108N_D147Y_E155V),
(D108Q_D147Y_E155V),
(D108M_D147Y_E155V),
(D108L_D147Y_E155V),
(D108K_D147Y_E155V),
(D108I_D147Y_E155V),
(D108F_D147Y_E155V),
(A106V_D108N_D147Y),
(A106V_D108M_D147Y_E155V),
(E59A_A106V_D108N_D147Y_E155V),
(E59A cat dead_A106V_D108N_D147Y_E155V),
(L84F_A106V_D108N_H123Y_D147Y_E155V_
    I156Y),
(L84F_A106V_D108N_H123Y_D147Y_E155V_I156F),
(R26G_L84F_A106V_R107H_D108N_H123Y_A142N_
    A143D_D147Y_E155V_I156F),
(E25G_R26G_L84F_A106V_R107H_D108N_H123Y_
    A142N_A143D_D147Y_E155V_I156F),
(E25D_R26G_L84F_A106V_R107K_D108N_
    H123Y_A142N_A143G_D147Y_E155V_I156F),
(R26Q_L84F_A106V_D108N_H123Y_A142N_
    D147Y_E155V_I156F),
(E25M_R26G_L84F_A106V_R107P_D108N_
    H123Y_A142N_A143D_D147Y_E155V _I156F),
(R26C_L84F_A106V_R107H_D108N_H123Y_
    A142N_D147Y_E155V_I156F),
(L84F_A106V_D108N_H123Y_A142N_A143L_
    D147Y_E155V_I156F),
(R26G_L84F_A106V_D108N_H123Y_A142N_
    D147Y_E155V_I156F),
(E25A_R26G_L84F_A106V_R107N_D108N_H123Y_
    A142N_A143E_D147Y_E155V _I156F),
(R26G_L84F_A106V_R107H_D108N_H123Y_
    A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_
    A143G_D147Y_E155V),
(R26G_A106V_D108N_R107H_A142N_A143D_
    D147Y_E155V),
(E25D_R26G_A106V_D108N_A142N_D147Y_
    E155V),
(A106V_R107K_D108N_A142N_D147Y_E155V), (A106V_D108N_A142N_A143G_D147Y_E155V),
(A106V_D108N_A142N_A143L_D147Y_E155V),
(H36L_R51L_L84F_A106V_D108N_H123Y_S146C_
    D147Y_E155V_I156F_K157N),
(N37T_P48T_M70L_L84F_A106V_D108N_H123Y_
    D147Y_149V_E155V_I156F),
(N37S_L84F_A106V_D108N_H123Y_D147Y_
    E155V_I156F_K161T),
(H36L_L84F_A106V_D108N_H123Y_D147Y_
    Q154H_E155V_I156F),
(N72S_L84F_A106V_D108N_H123Y_S146R_
    D147Y_E155V_I156F),
(H36L_P48L_L84F_A106V_D108N_H123Y_E134G_
    D147Y_E155V_I156F),
(H36L_L84F_A106V_D108N_H123Y_D147Y_
    E155V_I156F_K157N),
(H36L_L84F_A106V_D108N_H123Y_S146C_
    D147Y_E155V_I156F),
(L84F_A106V_D108N_H123Y_S146R_D147Y_
    E155V_I156F_K161T),
(N37S_R51H_D77G_L84F_A106V_D108N_H123Y_
    D147Y_E155V_I156F),
(R51L_L84F_A106V_D108N_H123Y_D147Y_
    E155V_I156F_K157N),
(D24G_Q71R_L84F_H96L_A106V_D108N_H123Y_
    D147Y_E155V_I156F_K160E),
(H36L_G67V_L84F_A106V_D108N_H123Y_
    S146T_D147Y_E155V_I156F),
(Q71L_L84F_A106V_D108N_H123Y_L137M_
    A143E_D147Y_E155V_I156F),
(E25G_L84F_A106V_D108N_H123Y_D147Y_
    E155V_I156F_Q159L),
(L84F_A91T_F104I_A106V_D108N_H123Y_
    D147Y_E155V_I156F),
(N72D_L84F_A106V_D108N_H123Y_G125A_
    D147Y_E155V_I156F),
(P48S_L84F_S97C_A106V_D108N_H123Y_D147Y_
    E155V_I156F),
(W23G_L84F_A106V_D108N_H123Y_D147Y_
    E155V_I156F),
(D24G_P48L_Q71R_L84F_A106V_D108N_H123Y_
    D147Y_E155V_I156F_Q159L),
(L84F_A106V_D108N_H123Y_A142N_D147Y_
    E155V_I156F),
(H36L_R51L_L84F_A106V_D108N_H123Y_A142N_
    S146C_D147Y_E155V_I156F_K157N),
(N37S_L84F_A106V_D108N_H123Y_A142N_
    D147Y_E155V_I156F_K161T),
(L84F_A106V_D108N_D147Y_E155V_I156F),
(R51L_L84F_A106V_D108N_H123Y_S146C_
    D147Y_E155V_I156F_K157N_K161T),
(L84F_A106V_D108N_H123Y_S146C_D147Y_
    E155V_I156F_K161T),
(L84F_A106V_D108N_H123Y_S146C_D147Y_
    E155V_I156F_K157N_K160E_K161T),
(L84F_A106V_D108N_H123Y_S146C_D147Y_
    E155V_I156F_K157N_K160E),
(R74Q_L84F_A106V_D108N_H123Y_D147Y_
    E155V_I156F),
(R74A_L84F_A106V_D108N_H123Y_D147Y_
    E155V_I156F),
(L84F_A106V_D108N_H123Y_D147Y_E155V_I156F),
(R74Q_L84F_A106V_D108N_H123Y_D147Y_
    E155V_I156F),
(L84F_R98Q_A106V_D108N_H123Y_D147Y_
    E155V_I156F), (L84F_A106V_D108N_H123Y_R129Q_D147Y_
    E155V_I156F),
(P48S_L84F_A106V_D108N_H123Y_A142N_D147Y_
    E155V_I156F),
(P48S_A142N),
(P48T_I49V_L84F_A106V_D108N_H123Y_A142N_
    D147Y_E155V_I156F_L157N),
(P48T_I49V_A142N),
(H36L_P48S_R51L_L84F_A106V_D108N_H123Y_
    S146C_D147Y_E155V_I156F_K157N),
(H36L_P48S_R51L_L84F_A106V_D108N_H123Y_
    S146C_A142N_D147Y_E155V_I156F
(H36L_P48T_I49V_R51L_L84F_A106V_D108N_
    H123Y_S146C_D147Y_E155V_I156F_K157N),
(H36L_P48T_I49V_R51L_L84F_A106V_D108N_
    H123Y_A142N_S146C_D147Y_E155V_I156F
    K157N),
(H36L_P48A_R51L_L84F_A106V_D108N_H123Y_
    S146C_D147Y_E155V_I156F_K157N),
(H36L_P48A_R51L_L84F_A106V_D108N_H123Y_
    A142N_S146C_D147Y_E155V_I156F _K157N),
(H36L_P48A_R51L_L84F_A106V_D108N_H123Y_
    S146C_A142N_D147Y_E155V_I156F _K157N),
(W23L_H36L_P48A_R51L_L84F_A106V_D108N_
    H123Y_S146C_D147Y_E155V_I156F _K157N),
(W23R_H36L_P48A_R51L_L84F_A106V_D108N_
    H123Y_S146C_D147Y_E155V_I156F _K157N),
(W23L_H36L_P48A_R51L_L84F_A106V_D108N_
    H123Y_S146R_D147Y_E155V_I156F _K161T),
(H36L_P48A_R51L_L84F_A106V_D108N_H123Y_
    S146C_D147Y_R152H_E155V_I156F _K157N),
(H36L_P48A_R51L_L84F_A106V_D108N_H123Y_
    S146C_D147Y_R152P_E155V_I156F _K157N),
(W23L_H36L_P48A_R51L_L84F_A106V_D108N_
    H123Y_S146C_D147Y_R152P_E155V_I156F
    K157N),
(W23L_H36L_P48A_R51L_L84F_A106V_D108N_
    H123Y_A142A_S146C_D147Y_E155V
    I156F_K157N),
(W23L_H36L_P48A_R51L_L84F_A106V_D108N_
    H123Y_A142A_S146C_D147Y_R152P
    E155V_I156F_K157N),
(W23L_H36L_P48A_R51L_L84F_A106V_D108N_
    H123Y_S146R_D147Y_E155V_I156F _K161T),
(W23R_H36L_P48A_R51L_L84F_A106V_D108N_
    H123Y_S146C_D147Y_R152P_E155V_I156F
    K157N),
(H36L_P48A_R51L_L84F_A106V_D108N_H123Y_
    A142N_S146C_D147Y_R152P_E155V
    I156F_K157N).

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the adenosine deaminase is TadA*7.10. In some embodiments, TadA*7.10 comprises at least one alteration. In particular embodiments, TadA*7.10 comprises one or more of the following alterations: Y147T, Y147R, Q154S, Y123H, V82S, T166R, and Q154R. The alteration Y123H is also referred to herein as H123H (the alteration H123Y in TadA*7.10 reverted back to Y123H (wt)). In other embodiments, the TadA*7.10 comprises a combination of alterations selected from the group of: Y147T+Q154R; Y147T+Q154S; Y147R+Q154S; V82S+ Q154S; V82S+Y147R; V82S+Q154R; V82S+Y123H; I76Y+V82S; V82S+Y123H+Y147T; V82S+Y123H+ Y147R; V82S+Y123H+Q154R; Y147R+Q154R+Y123H; Y147R+Q154R+I76Y; Y147R+Q154R+T166R; Y123H+ Y147R+Q154R+I76Y; V82S+Y123H+Y147R+Q154R; and I76Y+V82S+Y123H+Y147R+Q154R. In particular embodiments, an adenosine deaminase variant comprises a deletion of the C terminus beginning at residue 149, 150, 151, 152, 153, 154, 155, 156, and 157, relative to TadA*7.10, the TadA reference sequence, or a corresponding mutation in another TadA.

In other embodiments, a base editor of the invention is a monomer comprising an adenosine deaminase variant (e.g., TadA*8) comprising one or more of the following alterations: Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant (TadA*8) is a monomer comprising a combination of alterations selected from the group of: Y147T+Q154R; Y147T+Q154S; Y147R+Q154S; V82S+Q154S; V82S+Y147R; V82S+ Q154R; V82S+Y123H; I76Y+V82S; V82S+Y123H+ Y147T; V82S+Y123H+Y147R; V82S+Y123H+Q154R; Y147R+Q154R+Y123H; Y147R+Q154R+I76Y; Y147R+ Q154R+T166R; Y123H+Y147R+Q154R+I76Y; V82S+ Y123H+Y147R+Q154R; and I76Y+V82S+Y123H+ Y147R+Q154R, relative to TadA*7.10, the TadA reference sequence, or a corresponding mutation in another TadA. In other embodiments, a base editor is a heterodimer comprising a wild-type adenosine deaminase and an adenosine deaminase variant (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the base editor is a heterodimer comprising a TadA*7.10 domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+ Y123H; I76Y+V82S; V82S+Y123H+Y147T; V82S+ Y123H+Y147R; V82S+Y123H+Q154R; Y147R+Q154R+ Y123H; Y147R+Q154R+I76Y; Y147R+Q154R+T166R; Y123H+Y147R+Q154R+I76Y; V82S+Y123H+Y147R+ Q154R; and I76Y+V82S+Y123H+Y147R+Q154R, relative to TadA*7.10, the TadA reference sequence, or a corresponding mutation in another TadA.

In one embodiment, an adenosine deaminase is a TadA*8 that comprises or consists essentially of the following sequence or a fragment thereof having adenosine deaminase activity:

```
                                   (SEQ ID NO: 4)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD
```

In some embodiments, the TadA*8 is a truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In some embodiments the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

In some embodiments, adenosine deaminase base editors with specificity for NGT PAM may be generated as provided in Table 7 below.

```
-continued

TadA*7.10:
                                            (SEQ ID NO: 3)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD

TadA*8:
                                            (SEQ ID NO: 4)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG
```

TABLE 7

NGT PAM Variants

| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | s | V | R | Q | L |

In some embodiments the NGTN variant is variant 1. In some embodiments, the NGTN variant is variant 2. In some embodiments, the NGTN variant is variant 3. In some embodiments, the NGTN variant is variant 4. In some embodiments, the NGTN variant is variant 5. In some embodiments, the NGTN variant is variant 6.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g.,

```
-continued
RVVFGVRNAKTGAAGSLMDVLHYPGMNHRVEITEGILADECAALLCTFFR

MPRQVFNAQKKAQSSTD.
```

In particular embodiments, a TadA*8 comprises one or more mutations at any of the following positions shown in bold. In other embodiments, a TadA*8 comprises one or more mutations at any of the positions shown with underlining:

```
                                            (SEQ ID NO: 3)
MSEVEFSHEY WMRHALTLAK RARDEREVPV GAVLVLNNRV IGEGWNRAIG      50

LHDPTAHAEI MALRQGGLVM QNYRLIDATL YVTFEPCVMC AGAMIHSRIG     100

RVVFGVRNAK TGAAGSLMDV LHYPGMNHRV EITEGILADE CAALLCYFFR     150

MPRQVFNAQK KAQSSTD
``` provided as a monomer). In other embodiments, the base editor comprises TadA*8 and TadA(wt), which are capable of forming heterodimers. Exemplary sequences follow:

```
TadA(wt):
                                            (SEQ ID NO: 2)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD
```

For example, the TadA*8 comprises alterations at amino acid position 82 and/or 166 (e.g., V82S, T166R) alone or in combination with any one or more of the following Y147T, Y147R, Q154S, Y123H, and/or Q154R, relative to TadA*7.10, the TadA reference sequence, or a corresponding mutation in another TadA. In particular embodiments, a combination of alterations is selected from the group of Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In some embodiments, the adenosine deaminase is TadA*8, which comprises or consists essentially of the following sequence or a fragment thereof having adenosine deaminase activity:

```
                                        (SEQ ID NO: 4)
MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCTFFR MPRQVFNAQK

KAQSSTD
```

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA(wt), which are capable of forming heterodimers.

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some embodiments, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise an uracil glycosylase inhibitor (UGI) domain. In some embodiments, cellular DNA repair response to the presence of U: G heteroduplex DNA can be responsible for a decrease in nucleobase editing efficiency in cells. In such embodiments, uracil DNA glycosylase (UDG) can catalyze removal of U from DNA in cells, which can initiate base excision repair (BER), mostly resulting in reversion of the U:G pair to a C:G pair. In such embodiments, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB)

binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

Additionally, in some embodiments, a Gam protein can be fused to an N terminus of a base editor. In some embodiments, a Gam protein can be fused to a C-terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some embodiments, a mutation or mutations can change the length of a base editor domain relative to a wild-type domain. For example, a deletion of at least one amino acid in at least one domain can reduce the length of the base editor. In another case, a mutation or mutations do not change the length of a domain relative to a wild-type domain. For example, substitution(s) in any domain does/do not change the length of the base editor.

In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some embodiments, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase).

Base Editor System

Use of the base editor system provided herein comprises the steps of: (a) contacting a target nucleotide sequence of a polynucleotide (e.g., double- or single stranded DNA or RNA) of a subject with a base editor system comprising a nucleobase editor (e.g., an adenosine base editor) and a guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

Base editing system as provided herein provides a new approach to genome editing that uses a fusion protein containing a catalytically defective *Streptococcus pyogenes* Cas9, a cytidine deaminase, and an inhibitor of base excision repair to induce programmable, single nucleotide (C--T or A--G) changes in DNA without generating double-strand DNA breaks, without requiring a donor DNA template, and without inducing an excess of stochastic insertions and deletions.

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system comprises an adenosine base editor (ABE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some embodiments, a deaminase domain can be an adenine deaminase or an adenosine deaminase. In some embodiments, the adenosine base editor can deaminate adenine in DNA. In some embodiments, ABE comprises an evolved TadA variant.

Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, a single guide polynucleotide may be utilized to target a deaminase to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, the base editor inhibits base excision repair (BER) of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the base editing fusion proteins provided herein need to be positioned at a precise location, for example, where a target base is placed within a defined region (e.g., a "deamination window"). In some embodiments, a target can be within a 4 base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacterio-phage Mu Gam protein yields C:G-to-T:A base editors with higher efficiency and product purity" Science Advances 3:eaao4774 (2017), the entire contents of which are hereby incorporated by reference.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window. A deamination window can be the defined region in which a base editor acts upon and deami-nates a target nucleotide. In some embodiments, the deami-nation window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facili-tates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide program-mable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Non-limiting examples of protein domains which can be included in the fusion protein include deaminase domains (e.g., cytidine deaminase, adenosine deaminase), a uracil glycosylase inhibitor (UGI) domain, epitope tags, and reporter gene sequences.

Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including, but not limited to, maltose binding protein (MBP), S-tag, Lex A DNA binding domain (DBD) fusions, GAL4 DNA binding domain fusions, and herpes simplex virus (HSV) BP16 protein fusions.

In some embodiments, the adenosine base editor (ABE) can deaminate adenine in DNA. In some embodiments, ABE is generated by replacing APOBEC1 component of BE3 with natural or engineered E. coli TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of E. coli Endo V (inactivated with D35A mutation). In some embodiments, the ABE is ABE2.6 which has a linker twice as long (32 amino acids, $(SGGS)_2$-XTEN-$(SGGS)_2$ ("$(SGGS)_2$" disclosed as SEQ ID NO: 246)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild-type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I156F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type E. coli TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in Table 8 below. In some embodiments, the ABE is a sixth generation ABE. In some embodiments, the ABE is ABE6.1, ABE6.2, ABE6.3, ABE6.4, ABE6.5, or ABE6.6, as shown in Table 8 below. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in Table 8 below.

TABLE 8

| | | | | | | | | | | | Genotypes of ABEs | | | | | | | | | | |
|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |

TABLE 8-continued

|  | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| | | | | | | | | | | | | Genotypes of ABEs | | | | | | | | | | |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | T |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | c | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | N | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | I | V | L | N | F | S | V | N | Y | G | A | C | Y | R | V | F | N | K |

TABLE 8-continued

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | I | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | I | N | K |
| ABE7.7 | L | R | L | N | A | | L | N | F | S | V | N | Y | G | A | C | Y | P | V | F | N | K |
| ABE7.8 | I | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is an eighth generation ABE (ABE8). In some embodiments, the ABE8 contains a TadA*8 variant. In some embodiments, the ABE8 has a monomeric construct containing a TadA*8 variant ("ABE8.x-m"). In some embodiments, the ABE8 is ABE8.1-m, which has a monomeric construct containing TadA*7.10 with a YT47T mutation (TadA*8.1). In some embodiments, the ABE8 is ABE8.2-m, which has a monomeric construct containing TadA*7.10 with a Y147R mutation (TadA*8.2). In some embodiments, the ABE8 is ABE8.3-m, which has a monomeric construct containing TadA*7.10 with a Q154S mutation (TadA*8.3). In some embodiments, the ABE8 is ABE8.4-m, which has a monomeric construct containing TadA*7.10 with a Y123H mutation (TadA*8.4). In some embodiments, the ABE8 is ABE8.5-m, which has a monomeric construct containing TadA*7.10 with a V82S mutation (TadA*8.5). In some embodiments, the ABE8 is ABE8.6-m, which has a monomeric construct containing TadA*7.10 with a T166R mutation (TadA*8.6). In some embodiments, the ABE8 is ABE8.7-m, which has a monomeric construct containing TadA*7.10 with a Q154R mutation (TadA*8.7). In some embodiments, the ABE8 is ABE8.8-m, which has a monomeric construct containing TadA*7.10 with Y147R, Q154R, and Y123H mutations (TadA*8.8). In some embodiments, the ABE8 is ABE8.9-m, which has a monomeric construct containing TadA*7.10 with Y147R, Q154R and 176Y mutations (TadA*8.9). In some embodiments, the ABE8 is ABE8.10-m, which has a monomeric construct containing TadA*7.10 with Y147R, Q154R, and T166R mutations (TadA*8.10). In some embodiments, the ABE8 is ABE8.11-m, which has a monomeric construct containing TadA*7.10 with Y147T and Q154R mutations (TadA*8.11). In some embodiments, the ABE8 is ABE8.12-m, which has a monomeric construct containing TadA*7.10 with Y147T and Q154S mutations (TadA*8.12). In some embodiments, the ABE8 is ABE8.13-m, which has a monomeric construct containing TadA*7.10 with Y123H (Y123H reverted from H123Y), Y147R, Q154R and 176Y mutations (TadA*8.13). In some embodiments, the ABE8 is ABE8.14-m, which has a monomeric construct containing TadA*7.10 with 176Y and V82S mutations (TadA*8.14). In some embodiments, the ABE8 is ABE8.15-m, which has a monomeric construct containing TadA*7.10 with V82S and Y147R mutations (TadA*8.15). In some embodiments, the ABE8 is ABE8.16-m, which has a monomeric construct containing TadA*7.10 with V82S, Y123H (Y123H reverted from H123Y) and Y147R mutations (TadA*8.16). In some embodiments, the ABE8 is ABE8.17-m, which has a monomeric construct containing TadA*7.10 with V82S and Q154R mutations (TadA*8.17). In some embodiments, the ABE8 is ABE8.18-m, which has a monomeric construct containing TadA*7.10 with V82S, Y123H (Y123H reverted from H123Y) and Q154R mutations (TadA*8.18). In some embodiments, the ABE8 is ABE8.19-m, which has a monomeric construct containing TadA*7.10 with V82S, Y123H (Y123H reverted from H123Y), Y147R and Q154R mutations (TadA*8.19). In some embodiments, the ABE8 is ABE8.20-m, which has a monomeric construct containing TadA*7.10 with I76Y, V82S, Y123H (Y123H reverted from H123Y), Y147R and Q154R mutations (TadA*8.20). In some embodiments, the ABE8 is ABE8.21-m, which has a monomeric construct containing TadA*7.10 with Y147R and Q154S mutations (TadA*8.21). In some embodiments, the ABE8 is ABE8.22-m, which has a monomeric construct containing TadA*7.10 with V82S and Q154S mutations (TadA*8.22). In some embodiments, the ABE8 is ABE8.23-m, which has a monomeric construct containing TadA*7.10 with V82S and Y123H (Y123H reverted from H123Y) mutations (TadA*8.23). In some embodiments, the ABE8 is ABE8.24-m, which has a monomeric construct containing TadA*7.10 with V82S, Y123H (Y123H reverted from H123Y), and Y147T mutations (TadA*8.24).

In some embodiments, the ABE8 has a heterodimeric construct containing wild-type E. coli TadA fused to a TadA*8 variant ("ABE8.x-d"). In some embodiments, the ABE8 is ABE8.1-d, which has a heterodimeric construct containing wild-type E. coli TadA fused to TadA*7.10 with a YT47T mutation (TadA*8.1). In some embodiments, the ABE8 is ABE8.2-d, which has a heterodimeric construct containing wild-type E. coli TadA fused to TadA*7.10 with a YT47R mutation (TadA*8.2). In some embodiments, the ABE8 is ABE8.3-d, which has a heterodimeric construct containing wild-type E. coli TadA fused to TadA*7.10 with a Q154S mutation (TadA*8.3). In some embodiments, the ABE8 is ABE8.4-d, which has a heterodimeric construct containing wild-type E. coli TadA fused to TadA*7.10 with a Y123H mutation (TadA*8.4). In some embodiments, the ABE8 is ABE8.5-d, which has a heterodimeric construct containing wild-type E. coli TadA fused to TadA*7.10 with a V82S mutation (TadA*8.5). In some embodiments, the ABE8 is ABE8.6-d, which has a heterodimeric construct containing wild-type E. coli TadA fused to TadA*7.10 with a T166R mutation (TadA*8.6). In some embodiments, the ABE8 is ABE8.7-d, which has a heterodimeric construct containing wild-type E. coli TadA fused to TadA*7.10 with a Q154R mutation (TadA*8.7). In some embodiments, the ABE8 is ABE8.8-d, which has a heterodimeric construct containing wild-type E. coli TadA fused to TadA*7.10 with Y147R, Q154R, and Y123H mutations (TadA*8.8). In some embodiments, the ABE8 is ABE8.9-d, which has a heterodimeric construct containing wild-type E. coli TadA fused to TadA*7.10 with Y147R, Q154R and 176Y mutations (TadA*8.9). In some embodiments, the ABE8 is ABE8.10-d, which has a heterodimeric construct containing wild-type E. coli TadA fused to TadA*7.10 with Y147R, Q154R, and T166R mutations (TadA*8.10). In some embodiments, the ABE8 is ABE8.11-d, which has a heterodimeric construct containing wild-type E. coli TadA fused to TadA*7.10 with Y147T and Q154R mutations (TadA*8.11). In some embodiments, the ABE8 is ABE8.12-d, which has heterodimeric construct containing wild-type E. coli TadA fused to TadA*7.10 with Y147T and Q154S mutations (TadA*8.12). In some embodiments, the ABE8 is ABE8.13-d, which has a heterodimeric construct containing wild-type E. coli TadA fused to TadA*7.10 with Y123H (Y123H reverted from H123Y), Y147R, Q154R and 176Y mutations (TadA*8.13). In some embodiments, the ABE8 is ABE8.14-d, which has a heterodimeric construct containing wild-type E. coli TadA fused to TadA*7.10 with I76Y and V82S mutations (TadA*8.14). In some embodiments, the ABE8 is ABE8.15-d, which has a heterodimeric construct containing wild-type E. coli TadA fused to TadA*7.10 with V82S and Y147R mutations (TadA*8.15). In some embodiments, the ABE8 is ABE8.16-d, which has a heterodimeric construct containing wild-type E. coli TadA fused to TadA*7.10 with V82S, Y123H (Y123H reverted from H123Y) and Y147R mutations (TadA*8.16). In some embodiments, the ABE8 is ABE8.17-d, which has a heterodimeric construct containing wild-type E. coli TadA fused to TadA*7.10 with V82S and Q154R mutations (TadA*8.17). In some embodiments, the ABE8 is ABE8.18-d, which has a heterodimeric construct containing wild-type E. coli TadA fused to TadA*7.10 with V82S, Y123H (Y123H reverted from H123Y) and Q154R mutations (TadA*8.18). In some embodiments, the ABE8 is ABE8.19-d, which has a heterodimeric construct containing wild-type E. coli TadA fused to TadA*7.10 with V82S, Y123H (Y123H reverted from H123Y), Y147R and Q154R mutations (TadA*8.19). In some embodiments, the ABE8 is ABE8.20-d, which has a heterodimeric construct containing wild-type E. coli TadA fused to TadA*7.10 with 176Y, V82S, Y123H (Y123H reverted from H123Y), Y147R and Q154R mutations (TadA*8.20). In some embodiments, the ABE8 is ABE8.21-d, which has a heterodimeric construct containing wild-type E. coli TadA fused to TadA*7.10 with Y147R and Q154S mutations (TadA*8.21). In some embodiments, the ABE8 is ABE8.22-d, which has a heterodimeric construct containing wild-type E. coli TadA fused to TadA*7.10 with V82S and Q154S mutations (TadA*8.22). In some embodiments, the ABE8 is ABE8.23-d, which has a heterodimeric construct containing wild-type E. coli TadA fused to TadA*7.10 with V82S and Y123H (Y123H reverted from H123Y) mutations (TadA*8.23). In some embodiments, the ABE8 is ABE8.24-d, which has a heterodimeric construct containing wild-type E. coli TadA fused to TadA*7.10 with V82S, Y123H (Y123H reverted from H123Y), and Y147T mutations (TadA*8.24).

In some embodiments, the ABE8 has a heterodimeric construct containing TadA*7.10 fused to a TadA*8 variant ("ABE8.x-7"). In some embodiments, the ABE8 is ABE8.1-7, which has a heterodimeric construct containing TadA*7.10 fused to TadA*7.10 with a Y147T mutation (TadA*8.1). In some embodiments, the ABE8 is ABE8.2-7, which has a heterodimeric construct containing TadA*7.10 fused to TadA*7.10 with a Y147R mutation (TadA*8.2). In some embodiments, the ABE8 is ABE8.3-7, which has a heterodimeric construct containing TadA*7.10 fused to TadA*7.10 with a Q154S mutation (TadA*8.3). In some embodiments, the ABE8 is ABE8.4-7, which has a heterodimeric construct containing TadA*7.10 fused to TadA*7.10 with a Y123H mutation (TadA*8.4). In some embodiments, the ABE8 is ABE8.5-7, which has a heterodimeric construct containing TadA*7.10 fused to TadA*7.10 with a V82S mutation (TadA*8.5). In some embodiments, the ABE8 is ABE8.6-7, which has a heterodimeric construct containing TadA*7.10 fused to TadA*7.10 with a T166R mutation (TadA*8.6). In some embodiments, the ABE8 is ABE8.7-7, which has a heterodimeric construct containing TadA*7.10 fused to TadA*7.10 with a Q154R mutation (TadA*8.7). In some embodiments, the ABE8 is ABE8.8-7, which has a heterodimeric construct containing TadA*7.10 fused to TadA*7.10 with Y147R, Q154R, and Y123H mutations (TadA*8.8). In some embodiments, the ABE8 is ABE8.9-7, which has a heterodimeric construct containing TadA*7.10 fused to TadA*7.10 with Y147R, Q154R and 176Y mutations (TadA*8.9). In some embodiments, the ABE8 is ABE8.10-7, which has a heterodimeric construct containing TadA*7.10 fused to TadA*7.10 with Y147R, Q154R, and T166R mutations (TadA*8.10). In some embodiments, the ABE8 is ABE8.11-7, which has a heterodimeric construct containing TadA*7.10 fused to TadA*7.10 with Y147T and Q154R mutations (TadA*8.11). In some embodiments, the ABE8 is ABE8.12-7, which has a heterodimeric construct containing TadA*7.10 fused to TadA*7.10 with Y147T and Q154S mutations (TadA*8.12). In some embodiments, the ABE8 is ABE8.13-7, which has a heterodimeric construct containing TadA*7.10 fused to TadA*7.10 with Y123H (Y123H reverted from H123Y), Y147R, Q154R and 176Y mutations (TadA*8.13). In some embodiments, the ABE8 is ABE8.14-7, which has a heterodimeric construct containing TadA*7.10 fused to TadA*7.10 with 176Y and V82S mutations (TadA*8.14). In some embodiments, the ABE8 is ABE8.15-7, which has a heterodimeric construct containing TadA*7.10 fused to TadA*7.10 with V82S and Y147R mutations (TadA*8.15). In some embodiments, the ABE8 is ABE8.16-7, which has a heterodimeric construct containing TadA*7.10 fused to TadA*7.10 with V82S, Y123H (Y123H reverted from H123Y) and Y147R mutations (TadA*8.16). In some embodiments, the ABE8 is ABE8.17-7, which has a heterodimeric construct containing TadA*7.10 fused to TadA*7.10 with V82S and Q154R mutations (TadA*8.17). In some embodiments, the ABE8 is ABE8.18-7, which has a heterodimeric construct containing TadA*7.10 fused to TadA*7.10 with V82S, Y123H (Y123H reverted from H123Y) and Q154R mutations (TadA*8.18). In some embodiments, the ABE8 is ABE8.19-7, which has a heterodimeric construct containing TadA*7.10 fused to TadA*7.10 with V82S, Y123H (Y123H reverted from H123Y), Y147R and Q154R mutations (TadA*8.19). In some embodiments, the ABE8 is ABE8.20-7, which has a heterodimeric construct containing TadA*7.10 fused to TadA*7.10 with I76Y, V82S, Y123H (Y123H reverted from H123Y), Y147R and Q154R mutations (TadA*8.20). In some embodiments, the ABE8 is ABE8.21-7, which has a heterodimeric construct containing TadA*7.10 fused to TadA*7.10 with Y147R and Q154S mutations (TadA*8.21). In some embodiments, the ABE8 is ABE8.22-7, which has a heterodimeric construct containing TadA*7.10 fused to TadA*7.10 with V82S and Q154S mutations (TadA*8.22). In some embodiments, the ABE8 is ABE8.23-7, which has a heterodimeric construct containing TadA*7.10 fused to TadA*7.10 with V82S and Y123H (Y123H reverted from H123Y) mutations (TadA*8.23). In some embodiments, the ABE8 is ABE8.24-7, which has a heterodimeric construct containing TadA*7.10 fused to TadA*7.10 with V82S, Y123H (Y123H reverted from H123Y), and Y147T mutations (TadA*8.24

In some embodiments, the ABE is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m, ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d as shown in Table 9 below.

TABLE 9

| ABE8 | Adenosine Deaminase | Adenosine Deaminase Description |
|---|---|---|
| ABE8.1-m | TadA*8.1 | Monomer_TadA*7.10 + Y147T |
| ABE8.2-m | TadA*8.2 | Monomer_TadA*7.10 + Y147R |
| ABE8.3-m | TadA*8.3 | Monomer_TadA*7.10 + Q154S |
| ABE8.4-m | TadA*8.4 | Monomer_TadA*7.10 + Y123H |
| ABE8.5-m | TadA*8.5 | Monomer_TadA*7.10 + V82S |
| ABE8.6-m | TadA*8.6 | Monomer_TadA*7.10 + T166R |
| ABE8.7-m | TadA*8.7 | Monomer_TadA*7.10 + Q154R |
| ABE8.8-m | TadA*8.8 | Monomer_TadA*7.10 + Y147R_Q154R_Y123H |
| ABE8.9-m | TadA*8.9 | Monomer_TadA*7.10 + Y147R_Q154R_I76Y |
| ABE8.10-m | TadA*8.10 | Monomer_TadA*7.10 + Y147R_Q154R_T166R |
| ABE8.11-m | TadA*8.11 | Monomer_TadA*7.10 + Y147T_Q154R |
| ABE8.12-m | TadA*8.12 | Monomer_TadA*7.10 + Y147T_Q154S |
| ABE8.13-m | TadA*8.13 | Monomer_TadA*7.10 + Y123H_Y147R_Q154R_I76Y |
| ABE8.14-m | TadA*8.14 | Monomer_TadA*7.10 + I76Y_V82S |
| ABE8.15-m | TadA*8.15 | Monomer_TadA*7.10 + V82S_Y147R |
| ABE8.16-m | TadA*8.16 | Monomer_TadA*7.10 + V82S_Y123H_Y147R |
| ABE8.17-m | TadA*8.17 | Monomer_TadA*7.10 + V82S_Q154R |
| ABE8.18-m | TadA*8.18 | Monomer_TadA*7.10 + V82S_Y123H_Q154R |
| ABE8.19-m | TadA*8.19 | Monomer_TadA*7.10 + V82S_Y123H_Y147R_Q154R |
| ABE8.20-m | TadA*8.20 | Monomer_TadA*7.10 + I76Y_V82S_Y123H_Y147R_Q154R |
| ABE8.21-m | TadA*8.21 | Monomer_TadA*7.10 + Y147R_Q154S |
| ABE8.22-m | TadA*8.22 | Monomer_TadA*7.10 + V82S_Q154S |
| ABE8.23-m | TadA*8.23 | Monomer_TadA*7.10 + V82S_Y123H |
| ABE8.24-m | TadA*8.24 | Monomer_TadA*7.10 + V82S_Y123H_Y147T |
| ABE8.1-d | TadA*8.1 | Heterodimer_(WT) + (TadA*7.10 + Y147T) |
| ABE8.2-d | TadA*8.2 | Heterodimer_(WT) + (TadA*7.10 + Y147R) |
| ABE8.3-d | TadA*8.3 | Heterodimer_(WT) + (TadA*7.10 + Q154S) |
| ABE8.4-d | TadA*8.4 | Heterodimer_(WT) + (TadA*7.10 + Y123H) |
| ABE8.5-d | TadA*8.5 | Heterodimer_(WT) + (TadA*7.10 + V82S) |
| ABE8.6-d | TadA*8.6 | Heterodimer_(WT) + (TadA*7.10 + T166R) |
| ABE8.7-d | TadA*8.7 | Heterodimer_(WT) + (TadA*7.10 + Q154R) |
| ABE8.8-d | TadA*8.8 | Heterodimer_(WT) + (TadA*7.10 + Y147R_Q154R_Y123H) |
| ABE8.9-d | TadA*8.9 | Heterodimer_(WT) + (TadA*7.10 + Y147R_Q154R_I76Y) |
| ABE8.10-d | TadA*8.10 | Heterodimer_(WT) + (TadA*7.10 + Y147R_Q154R_T166R) |
| ABE8.11-d | TadA*8.11 | Heterodimer_(WT) + (TadA*7.10 + Y147T_Q154R) |
| ABE8.12-d | TadA*8.12 | Heterodimer_(WT) + (TadA*7.10 + Y147T_Q154S) |
| ABE8.13-d | TadA*8.13 | Heterodimer_(WT) + (TadA*7.10 + Y123H_Y147T_Q154R_I76Y) |
| ABE8.14-d | TadA*8.14 | Heterodimer_(WT) + (TadA*7.10 + I76Y_V82S) |
| ABE8.15-d | TadA*8.15 | Heterodimer_(WT) + (TadA*7.10 + V82S_Y147R) |
| ABE8.16-d | TadA*8.16 | Heterodimer_(WT) + (TadA*7.10 + V82S_Y123H_Y147R) |
| ABE8.17-d | TadA*8.17 | Heterodimer_(WT) + (TadA*7.10 + V82S_Q154R) |
| ABE8.18-d | TadA*8.18 | Heterodimer_(WT) + (TadA*7.10 + V82S_Y123H_Q154R) |
| ABE8.19-d | TadA*8.19 | Heterodimer_(WT) + (TadA*7.10 + V82S_Y123H_Y147R_Q154R) |
| ABE8.20-d | TadA*8.20 | Heterodimer_(WT) + (TadA*7.10 + I76Y_V82S_Y123H_Y147R_Q154R) |
| ABE8.21-d | TadA*8.21 | Heterodimer_(WT) + (TadA*7.10 + Y147R_Q154S) |
| ABE8.22-d | TadA*8.22 | Heterodimer_(WT) + (TadA*7.10 + V82S_Q154S) |
| ABE8.23-d | TadA*8.23 | Heterodimer_(WT) + (TadA*7.10 + V82S_Y123H) |
| ABE8.24-d | TadA*8.24 | Heterodimer_(WT) + (TadA*7.10 + V82S_Y123H_Y147T) |

In some embodiments, base editors (e.g., ABE8) are generated by cloning an adenosine deaminase variant (e.g., TadA*8) into a scaffold that includes a circular permutant Cas9 (e.g., CP5 or CP6) and a bipartite nuclear localization sequence. In some embodiments, the base editor (e.g., ABE7.9, ABE7.10, or ABE8) is an NGC PAM CP5 variant (S. pyrogenes Cas9 or spVRQR Cas9). In some embodiments, the base editor (e.g., ABE7.9, ABE7.10, or ABE8) is an AGA PAM CP5 variant (S. pyrogenes Cas9 or spVRQR Cas9). In some embodiments, the base editor (e.g., ABE7.9, ABE7.10, or ABE8) is an NGC PAM CP6 variant (S. pyrogenes Cas9 or spVRQR Cas9). In some embodiments, the base editor (e.g. ABE7.9, ABE7.10, or ABE8) is an AGA PAM CP6 variant (S. pyrogenes Cas9 or spVRQR Cas9).

In some embodiments, the ABE has a genotype as shown in Table 10 below.

TABLE 10

| | | | | | | | | | | | Genotypes of ABEs | | | | | | | | | | | |
|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

As shown in Table 11 below, genotypes of 40 ABE8s are described. Residue positions in the evolved E. coli TadA portion of ABE are indicated. Mutational changes in ABE8 are shown when distinct from ABE7.10 mutations. In some embodiments, the ABE has a genotype of one of the ABEs as shown in Table 11 below.

TABLE 11

| | | | | | | | | | | Residue Identity in Evolved TadA | | | | | | | | |
|---|---|---|---|---|---|---|---|---|---|---|---|---|---|---|---|---|---|---|
| | 23 | 36 | 48 | 51 | 76 | 82 | 84 | 106 | 108 | 123 | 146 | 147 | 152 | 154 | 155 | 156 | 157 | 166 |
| ABE7.10 | R | L | A | L | I | V | F | V | N | Y | C | Y | P | Q | V | F | N | T |
| ABE8.1-m | | | | | | | | | | | | T | | | | | | |
| ABE8.2-m | | | | | | | | | | | | R | | | | | | |
| ABE8.3-m | | | | | | | | | | | | | | S | | | | |
| ABE8.4-m | | | | | | | | | | H | | | | | | | | |
| ABE8.5-m | | | | | | S | | | | | | | | | | | | |
| ABE8.6-m | | | | | | | | | | | | | | | | | | R |
| ABE8.7-m | | | | | | | | | | | | | | R | | | | |
| ABE8.8-m | | | | | | | | | | H | | R | | R | | | | |
| ABE8.9-m | | | | | Y | | | | | | | R | | R | | | | |
| ABE8.10-m | | | | | | | | | | | | R | | R | | | | R |
| ABE8.11-m | | | | | | | | | | | | T | | R | | | | |
| ABE8.12-m | | | | | | | | | | | | T | | S | | | | |
| ABE8.13-m | | | | | Y | | | | | H | | R | | R | | | | |
| ABE8.14-m | | | | | Y | S | | | | | | | | | | | | |
| ABE8.15-m | | | | | | S | | | | | | R | | | | | | |
| ABE8.16-m | | | | | | S | | | | H | | R | | | | | | |
| ABE8.17-m | | | | | | S | | | | | | | | R | | | | |
| ABE8.18-m | | | | | | S | | | | H | | | | R | | | | |
| ABE8.19-m | | | | | | S | | | | H | | R | | R | | | | |
| ABE8.20-m | | | | | Y | S | | | | H | | R | | R | | | | |
| ABE8.21-m | | | | | | | | | | | | R | | S | | | | |
| ABE8.22-m | | | | | | S | | | | | | | | S | | | | |

TABLE 11-continued

| | 23 | 36 | 48 | 51 | 76 | 82 | 84 | 106 | 108 | 123 | 146 | 147 | 152 | 154 | 155 | 156 | 157 | 166 |
|---|---|---|---|---|---|---|---|---|---|---|---|---|---|---|---|---|---|---|
| | | | | | | | | | | Residue Identity in Evolved TadA | | | | | | | | |
| ABE8.23-m | | | | | | S | | | | H | | | | | | | | |
| ABE8.24-m | | | | | | S | | | | H | T | | | | | | | |
| ABE8.1-d | | | | | | | | | | | T | | | | | | | |
| ABE8.2-d | | | | | | | | | | | R | | | | | | | |
| ABE8.3-d | | | | | | | | | | | | | S | | | | | |
| ABE8.4-d | | | | | | | | | | H | | | | | | | | |
| ABE8.5-d | | | | | | | S | | | | | | | | | | | |
| ABE8.6-d | | | | | | | | | | | | | | | | R | | |
| ABE8.7-d | | | | | | | | | | | | R | | | | | | |
| ABE8.8-d | | | | | | | | | | H | R | R | | | | | | |
| ABE8.9-d | | | | | Y | | | | | | R | R | | | | | | |
| ABE8.10-d | | | | | | | | | | | R | R | | R | | | | |
| ABE8.11-d | | | | | | | | | | | T | R | | | | | | |
| ABE8.12-d | | | | | | | | | | | T | S | | | | | | |
| ABE8.13-d | | | | | Y | | | | | H | R | R | | | | | | |
| ABE8.14-d | | | | | Y | | S | | | | | | | | | | | |
| ABE8.15-d | | | | | | S | | | | | R | | | | | | | |
| ABE8.16-d | | | | | | S | | | | H | R | | | | | | | |
| ABE8.17-d | | | | | | S | | | | | | | R | | | | | |
| ABE8.18-d | | | | | | S | | | | H | | | R | | | | | |
| ABE8.19-d | | | | | | S | | | | H | R | R | | | | | | |
| ABE8.20-d | | | | | Y | S | | | | H | R | R | | | | | | |
| ABE8.21-d | | | | | | | | | | | R | | S | | | | | |
| ABE8.22-d | | | | | | S | | | | | | | S | | | | | |
| ABE8.23-d | | | | | | S | | | | H | | | | | | | | |
| ABE8.24-d | | | | | | S | | | | H | T | | | | | | | |

In some embodiments, the base editor is ABE8.1, which comprises or consists essentially of the following sequence or a fragment thereof having adenosine deaminase activity:

```
ABE8.1_Y147T_CP5_NGC_PAM_monomer
                              (SEQ ID NO: 247)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD*SGGSSGGSSGSETPGTSES*

*ATPESSGGSSGGS*

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD
```

-continued

```
PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPRAFKYF

DTTIARKEYRSTKEVLDATLIHQSITGLYETRIDLSQLGGD

*GGSGGSGGSGGSGGSGGSGG*

MDKKYSIGLAIGTNSVGWAVITDEYKVPSK

KFKVLGNTDRHSIKKNLIGALLFDSGETAEATRLKRTARRRYTRRKNRIC

YLQEIFSNEMAKVDDSFFHRLEESFLVEEDKKHERHPIFGNIVDEVAYHE
```

-continued

KYPTIYHLRKKLVDSTDKADLRLIYLALAHMIKFRGHFLIEGDLNPDNSD

VDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLA

QIGDQYADLFLAAKNLSDAILLSDILRVNTEITKAPLSASMIKRYDEHHQ

DLTLLKALVRQQLPEKYKEIFFDQSKNGYAGYIDGGASQEEFYKFIKPIL

EKMDGTEELLVKLNREDLLRKQRTFDNGSIPHQIHLGELHAILRRQEDFY

PFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYV

TEGMRKPAFLSGEQKKAIVDLLFKTNRKVTVKQLKEDYFKKIECFDSVEI

SGVEDRFNASLGTYHDLLKIIKDKDFLDNEENEDILEDIVLTLTLFEDRE

MIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGS

PAIKKGILQTVKVVDELVKVMGRHKPENIVIEMARENQTTQKGQKNSRER

MKRIEEGIKELGSQILKEHPVENTQLQNEKLYLYYLQNGRDMYVDQELDI

NRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKH

VAQILDSRMNTKYDENDKLIREVKVITLKSKLVSDFRKDFQFYKVREINN

YHHAHDAYLNAWGTALIKKYPKLESEFVYGDYKVYDVRKMIAKSEQ<u>EGAD</u>

<u>KRTADGSEFESPKKKRKV</u>*

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.1, which comprises or consists essentially of the following sequence or a fragment thereof having adenosine deaminase activity:

pNMG-B335 ABE8.1_Y147T_CP5_NGC PAM_monomer
(SEQ ID NO: 247)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RWFGVRNAKTGAAGSLMDVLHYPGMNHRVEITEGILADECAALLCTFFRM

PRQVFNAQKKAQSSTDSGGSS*GGSSGSETPGTSESATPESSGGSSGGS*EI

GKATAKYFFYSNIMNFFKTEITLANGEIRKRPLIETNGETGEIVWDKGRD

FATVRKVLSMPQVNIVKKTEVQTGGFSKESILPKRNSDKLIARKKDWDPK

KYGGFMQPTVAYSVLVVAKVEKGKSKKLKSVKELLGITIMERSSFEKNPI

DFLEAKGYKEVKKDLIIKLPKYSLFELENGRKRMLASAKFLQKGNELALP

SKYVNFLYLASHYEKLKGSPEDNEQKQLFVEQHKHYLDEIIEQISEFSKR

VILADANLDKVLSAYNKHRDKPIREQAENIIHLFTLTNLGAPRAFKYFDT

TIARKEYRSTKEVLDATLIHQSITGLYETRIDLSQLGGD*GGSGGSGGSGG*

*SGGSGGSGGM*DKKYSIGLAIGTNSVGWAVITDEYKVPSKKFKVLGNTDRH

SIKKNLIGALLFDSGETAEATRLKRTARRRYTRRKNRICYLQEIFSNEMA

KVDDSFFHRLEESFLVEEDKKHERHPIFGNIVDEVAYHEKYPTIYHLRKK

LVDSTDKADLRLIYLALAHMIKFRGHFLIEGDLNPDNSDVDKLFIQLVQT

-continued

YNQLFEENPINASGVDAKAILSARLSKSRRLENLIAQLPGEKKNGLFGNL

IALSLGLTPNFKSNFDLAEDAKLQLSKDTYDDDLDNLLAQIGDQYADLFL

AAKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELLV

KLNREDLLRKQRTFDNGSIPHQIHLGELHAILRRQEDFYPFLKDNREKIE

KILTFRIPYYVGPLARGNSRFAWMTRKSEETITPWNFEEWDKGASAQSFI

ERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLG

TYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVK

VVDELVKVMGRHKPENIVIEMARENQTTQKGQKNSRERMKRIEEGIKELG

SQILKEHPVENTQLQNEKLYLYYLQNGRDMYVDQELDINRLSDYDVDHIV

PQSFLKDDSIDNKVLTRSDKNRGKSDNVPSEEVVKKMKNYWRQLLNAKLI

TQRKFDNLTKAERGGLSELDKAGFIKRQLVETRQITKHVAQILDSRMNTK

YDENDKLIREVKVITLKSKLVSDFRKDFQFYKVREINNYHHAHDAYLNAW

GTALIKKYPKLESEFVYGDYKVYDVRKMIAKSEQ<u>EGADKRTADGSEFESP</u>

<u>KKKRKV</u>*

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.14, which comprises or consists essentially of the following sequence or a fragment thereof having adenosine deaminase activity:

pNMG-357_ABE8.14 with NGC PAM CP5
(SEQ ID NO: 248)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RWFGARDAKTGAAGSLMDVLHHPGMNHRVEITEGILADEGAALLSDFFRM

RRQEIKAQKKAQSSTDGGSSGGS*SGSETPGTSESATPESSGGSSGGS*MSE

VEFSHEYWMRHALTLAKRARDEREVPVGAVLVLNNRVIGEGWNRAIGLHD

PTAHAEIMALRQGGLVMQNYRLIDATLYVTFEPCVMCAGAMIHSRIGRWF

GVRNAKTGAAGSLMDVLHYPGMNHRVEITEGILADECAALLCTFFRMPRQ

VFNAQKKAQSSTD*SGGSSGGSSGSETPGTSESATPESSGGSSGGS*EIGKA

TAKYFFYSNIMNFFKTEITLANGEIRKRPLIETNGETGEIVWDKGRDFAT

VRKVLSMPQVNIVKKTEVQTGGFSKESILPKRNSDKLIARKKDWDPKKYG

GFMQPTVAYSVLVVAKVEKGKSKKLKSVKELLGITIMERSSFEKNPIDFL

EAKGYKEVKKDLIIKLPKYSLFELENGRKRMLASAKFLQKGNELALPSKY

VNFLYLASHYEKLKGSPEDNEQKQLFVEQHKHYLDEIIEQISEFSKRVIL

ADANLDKVLSAYNKHRDKPIREQAENIIHLFTLTNLGAPRAFKYFDTTIA

RKEYRSTKEVLDATLIHQSITGLYETRIDLSQLGGD*GGSGGSGGSGGSGG*

-continued

*SGGSGGM*DKKYSIGLAIGTNSVGWAVITDEYKVPSKKFKVLGNTDRHSIK

KNLIGALLFDSGETAEATRLKRTARRRYTRRKNRICYLQEIFSNEMAKVD

DSFFHRLEESFLVEEDKKHERHPIFGNIVDEVAYHEKYPTIYHLRKKLVD

STDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIAL

SLGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLN

REDLLRKQRTFDNGSIPHQIHLGELHAILRRQEDFYPFLKDNREKIEKIL

TFRIPYYVGPLARGNSRFAWMTRKSEETITPWNFEEWDKGASAQSFIERM

TNFDKNLPNEKVLPKHSLLYEYFTVYNELTKVKYVTEGMRKPAFLSGEQK

KAIVDLLFKTNRKVTVKQLKEDYFKKIECFDSVEISGVEDRFNASLGTYH

DLLKIIKDKDFLDNEENEDILEDIVLTLTLFEDREMIEERLKTYAHLFDD

KVMKQLKRRRYTGWGRLSRKLINGIRDKQSGKTILDFLKSDGFANRNFMQ

LIHDDSLTFKEDIQKAQVSGQGDSLHEHIANLAGSPAIKKGILQTVKWDE

LVKVMGRHKPENIVIEMARENQTTQKGQKNSRERMKRIEEGIKELGSQIL

KEHPVENTQLQNEKLYLYYLQNGRDMYVDQELDINRLSDYDVDHIVPQSF

LKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDEN

DKLIREVKVITLKSKLVSDFRKDFQFYKVREINNYHHAHDAYLNAWGTAL

IKKYPKLESEFVYGDYKVYDVRKMIAKSEQ<u>EGADKRTADGSEFESPKKKR</u>

<u>KV</u>*

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.8-m, which comprises or consists essentially of the following sequence or a fragment thereof having adenosine deaminase activity:

ABE8.8-m (SEQ ID NO: 249)

MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVR<u>N</u>AKTGAAGSLMDVLH<u>H</u>PGMNHRVEITEGILADECAALLC<u>R</u>FFR

MPR<u>R</u>VFNAQKKAQSSTD*SGGSSGGSSGSETPGTSESATPESSGGSSGGS*D

KKYSIGL<u>A</u>IGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

-continued

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD<u>EGADKRTADGSEFESPKKKR</u>KV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.8-d, which comprises or consists essentially of the following sequence or a fragment thereof having adenosine deaminase activity.

ABE8.8-d (SEQ ID NO: 250)

MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD*SGGSSGGSSGSETPGTSESATPESSGGSSGGSS*

EVEFSHEYWMRHALTLAKRARDEREVPVGAVLVLNNRVIGEGWNRAIGLH

DPTAHAEIMALRQGGLVMQNYRLIDATLYVTFEPCVMCAGAMIHSRIGRV

VFGVR<u>N</u>AKTGAAGSLMDVLH<u>H</u>PGMNHRVEITEGILADECAALLC<u>R</u>FFRMP

<u>RR</u>VFNAQKKAQSSTD*SGGSSGGSSGSETPGTSESATPESSGGSSGGS*DKK

YSIGL<u>A</u>IGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

-continued

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGD<u>EGADKRTADGSEFESPKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-m, which comprises or consists essentially of the following sequence or a fragment thereof having adenosine deaminase activity ABE8.13-m (SEQ ID NO: 251)

MSEVEFSHEYWMRHALTLAKRARDEREVPVGAVLVLNNRVIGEGWNRAIG

LHDPTAHAEIMALRQGGLVMQN<u>Y</u>RLYDATLYVTFEPCVMCAGAMIHSRIG

RVVFGVRNAKTGAAGSLMDVLH<u>H</u>PGMNHRVEITEGILADECAALLC<u>R</u>FFR

-continued

MPR<u>R</u>VFNAQKKAQSSTD*SGGSSGGSSGSETPGTSESATPESSGGSSGGS*D

KKYSIGL<u>A</u>IGTNSVGWAVITDEYKVPSKKFKVLGNTDRHSIKKNLIGALL

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSI

TGLYETRIDLSQLGGD<u>EGADKRTADGSEFESPKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-d, which comprises or consists essentially of the following sequence or a fragment thereof having adenosine deaminase activity.

ABE8.13-d (SEQ ID NO: 252)

MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

-continued

```
MRRQEIKAQKKAQSSTDSGGSSGGSSGSETPGTSESATPESSGGSSGGSS

EVEFSHEYWMRHALTLAKRARDEREVPVGAVLVLNNRVIGEGWNRAIGLH

DPTAHAEIMALRQGGLVMQNYRLYDATLYVTFEPCVMCAGAMIHSRIGRV

VFGVRNAKTGAAGSLMDVLHHPGMNHRVEITEGILADECAALLCRFFRMP

RRVFNAQKKAQSSTDSGGSSGGSSGSETPGTSESATPESSGGSSGGSDKK

YSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGDEGADKRTADGSEFESPKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-m, which comprises or consists essentially of the following sequence or a fragment thereof having adenosine deaminase activity:

ABE8.17-m (SEQ ID NO: 253)

```
MSEVEFSHEYWMRHALTLAKRARDEREVPVGAVLVLNNRVIGEGWNRAIG

LHDPTAHAEIMALRQGGLVMQNYRLIDATLYSTFEPCVMCAGAMIHSRIG

RVVFGVRNAKTGAAGSLMDVLHYPGMNHRVEITEGILADECAALLCYFFR

MPRRVFNAQKKAQSSTDSGGSSGGSSGSETPGTSESATPESSGGSSGGSD

KKYSIGLAIGTNSVGWAVITDEYKVPSKKFKVLGNTDRHSIKKNLIGALL
```

-continued

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSI

TGLYETRIDLSQLGGD<u>EGADKRTADGSEFESPKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-d, which comprises or consists essentially of the following sequence or a fragment thereof having adenosine deaminase activity:

ABE8.17-d
(SEQ ID NO: 254)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQS STD *SGGSSGGSSGSGSETPGTSESATPESSGGSSGGSS*

EVEFSHEYWMRHALTLAKRARDEREVPVGAVLVLNNRVIGEGWNRAIGLH

-continued

DPTAHAEIMALRQGGLVMQNYRLIDATLY<u>S</u>TFEPCVMCAGAMIHSRIGRV

VFGVRNAKTGAAGSLMDVLHYPGMNHRVEITEGILADECAALLCYFFRMP

<u>RR</u>VFNAQKKAQSSTD*SGGSSGGSSGSETPGTSESATPESSGGSSGGS*DKK

YSIGL<u>A</u>IGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGD<u>EGADKRTADGSEFESPKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-m, which comprises or consists essentially of the following sequence or a fragment thereof having adenosine deaminase activity.

ABE8.20-m
                                                                    (SEQ ID NO: 255)
MSEVEFSHEYWMRHALTLAKRARDEREVPVGAVLVLNNRVIGEGWNRAIG

LHDPTAHAEIMALRQGGLVMQNYRLYDATLYSTFEPCVMCAGAMIHSRIG

RVVFGVRNAKTGAAGSLMDVLHHPGMNHRVEITEGILADECAALLCRFFR

MPRRVFNAQKKAQSSTD*SGGSSGGSSGSGSETPGTSESATPESSGGSSGGS*D

KKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSI

TGLYETRIDLSQLGGDEGADKRTADGSEFESPKKKRKV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-d, which comprises or consists essentially of the following sequence or a fragment thereof having adenosine deaminase activity.

ABE8.20-d
                                                                    (SEQ ID NO: 256)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD*SGGSSGGSSGSGSETPGTSESATPESSGGSSGGSS*

EVEFSHEYWMRHALTLAKRARDEREVPVGAVLVLNNRVIGEGWNRAIGLH

-continued

DPTAHAEIMALRQGGLVMQNYRLYDATLYSTFEPCVMCAGAMIHSRIGRV

VFGVRNAKTGAAGSLMDVLHHPGMNHRVEITEGILADECAALLCRFFRMP

RRVFNAQKKAQSSTD*SGGSSGGSSGSETPGTSESATPESSGGSSGGS*DKK

YSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

-continued

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGD<u>GADKRTADGSEFESPKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, an ABE8 of the invention is selected from the following sequences:

01. monoABE8.1_bpNLS + Y147T (SEQ ID NO: 257)

MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

-continued

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 02. monoABE8.1_bpNLS + Y147R
                                                        (SEQ ID NO: 258)
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCRFFRMPRQVFNAQKKAQSSTDSGGSSGGSSGSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 03. monoABE8.1_bpNLS + Q154S
                                                        (SEQ ID NO: 259)
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCYFFRMPRSVFNAQKKAQSSTDSGGSSGGSSGSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

-continued

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 4. monoABE8.1_bpNLS + Y123H (SEQ ID NO: 260)

MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHHP

GMNHRVEITEGILADECAALLCYFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 5. monoABE8.1_bpNLS + V82S
                                                          (SEQ ID NO: 261)
MSEVEFSHEYWMRHALTLAKRARDEREVPVGAVLVLNNRVIGEGWNRAIGLHDPTAHAEIMA

LRQGGLVMQNYRLIDATLYSTFEPCVMCAGAMIHSRIGRVVFGVRNAKTGAAGSLMDVLHYP

GMNHRVEITEGILADECAALLCYFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 06. monoABE8.1_bpNLS + T166R
                                                          (SEQ ID NO: 262)
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCYFFRMPRQVFNAQKKAQSSRDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

-continued

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 07. monoABE8.1_bpNLS + Q154R (SEQ ID NO: 263)

MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCYFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

-continued
```
MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 08. monoABE8.1 bpNLS + Y147R Q154R Y123H
                                          (SEQ ID NO: 264)
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHHP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 09. monoABE8.1_bpNLS + Y147R_Q154R_176Y
                                          (SEQ ID NO: 265)
MSEVEFSHEYWMRHALTLAKRARDEREVPVGAVLVLNNRVIGEGWNRAIGLHDPTAHAEIMA

LRQGGLVMQNYRLYDATLYVTFEPCVMCAGAMIHSRIGRVVFGVRNAKTGAAGSLMDVLHYP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG
```

-continued

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 10. monoABE8.1_bpNLS + Y147R_Q154R_T166R (SEQ ID NO: 266)

MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCRFFRMPRRVFNAQKKAQSSRDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

-continued

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 11. monoABE8.1_bpNLS + Y147T_Q154R
                                              (SEQ ID NO: 267)
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRRVFNAQKKAQSSTDSGGSSGGSSGSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 12. monoABE8.1_bpNLS + Y147T_Q154S
                                              (SEQ ID NO: 268)
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRSVFNAQKKAQSSTDSGGSSGGSSGSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

-continued

```
LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 13. monoABE8.1_bpNLS + H123Y123H_Y147R_Q154R_I76Y
                                                (SEQ ID NO: 269)
MSEVEFSHEYWMRHALTLAKRARDEREVPVGAVLVLNNRVIGEGWNRAIGLHDPTAHAEIMA

LRQGGLVMQNYRLYDATLYVTFEPCVMCAGAMIHSRIGRVVFGVRNAKTGAAGSLMDVLHHP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI
```

US 12,600,971 B2

-continued

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV 14. monoABE8.1_bpNLS + V82S + Q154R (SEQ ID NO: 270)

MSEVEFSHEYWMRHALTLAKRARDEREVPVGAVLVLNNRVIGEGWNRAIGLHDPTAHAEIMA

LRQGGLVMQNYRLIDATLYSTFEPCVMCAGAMIHSRIGRVVFGVRNAKTGAAGSLMDVLHYP

GMNHRVEITEGILADECAALLCYFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV

In some embodiments, the base editor is a fusion protein comprising a polynucleotide programmable nucleotide binding domain (e.g., Cas9-derived domain) fused to a nucleobase editing domain (e.g., all or a portion of a deaminase domain). In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion) relative to a wild-type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g., adjacent domains) of the base editor disclosed herein can be connected to each other with or without the use of one or more linker domains (e.g., an XTEN linker domain). In some embodiments, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., an adenosine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., UGI, etc.).

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated. In some embodiments, a linker domain comprises the amino acid sequence SGSETPGTSESATPES (SEQ ID NO: 60), which can also be referred to as the XTEN linker. Any method for linking the fusion protein domains can be employed (e.g., ranging from very flexible linkers of the form (SGGS)n (SEQ ID NO: 197), (GGGS)n (SEQ ID NO: 271), (GGGGS)n (SEQ ID NO: 272), and (G)n, to more rigid linkers of the form (EAAAK)n (SEQ ID NO: 273), (GGS)n, SGSETPGTSESATPES (SEQ ID NO: 60) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference), or $(XP)_n$ motif, in order to achieve the optimal length for activity for the nucleobase editor. In some embodiments, n is 1, 2, 3, 4, 5, 6, 7, 8, 9, 10, 11, 12, 13, 14, or 15.

In some embodiments, the linker comprises a $(GGS)_n$ motif (SEQ ID NO: 274), wherein n is 1, 3, or 7. In some embodiments, the Cas9 domain of the fusion proteins provided herein are fused via a linker comprising the amino acid sequence SGSETPGTSESATPES (SEQ ID NO: 60). In some embodiments, a linker comprises a plurality of proline residues and is 5-21, 5-14, 5-9, 5-7 amino acids in length, e.g., PAPAP (SEQ ID NO: 275), PAPAPA (SEQ ID NO: 276), PAPAPAP (SEQ ID NO: 277), PAPAPAPA (SEQ ID NO: 278), $P(AP)_4$ (SEQ ID NO: 279), $P(AP)_7$ (SEQ ID NO: 280), $P(AP)_{10}$ (SEQ ID NO: 281) (see, e.g., Tan J, Zhang F, Karcher D, Bock R. Engineering of high-precision base editors for site-specific single nucleotide replacement. Nat Commun. 2019 Jan. 25; 10(1):439; the entire contents are incorporated herein by reference). Such proline-rich linkers are also termed "rigid" linkers.

A fusion protein of the invention comprises a nucleic acid editing domain. In some embodiments, the deaminase is an adenosine deaminase. In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase.

Linkers

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.).

In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length.

In some embodiments, the adenosine deaminase and the napDNAbp are fused via a linker that is 4, 16, 32, or 104 amino acids in length. In some embodiments, the linker is about 3 to about 104 amino acids in length. In some embodiments, any of the fusion proteins provided herein, comprise an adenosine deaminase and a Cas9 domain that are fused to each other via a linker. Various linker lengths and flexibilities between the deaminase domain (e.g., an engineered ecTadA) and the Cas9 domain can be employed (e.g., ranging from very flexible linkers of the form (GGGS)$_n$ (SEQ ID NO: 271), (GGGGS)$_n$ (SEQ ID NO: 272), and (G)$_n$ to more rigid linkers of the form (EAAAK)$_n$ (SEQ ID NO: 273), (SGGS)$_n$ (SEQ ID NO: 197), SGSETPGTSESATPES (SEQ ID NO: 60) (see, e.g., Guilinger J P, Thompson D B, Liu DR. Fusion of catalytically inactive Cas9 to FokI nuclease improves the specificity of genome modification. Nat. Biotechnol. 2014; 32(6): 577-82; the entire contents are incorporated herein by reference) and (XP)$_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a (GGS)$_n$ motif (SEQ ID NO: 274), wherein n is 1, 3, or 7. In some embodiments, the adenosine deaminase and the Cas9 domain of any of the fusion proteins provided herein are fused via a linker (e.g., an XTEN linker) comprising the amino acid sequence SGSETPGTSESATPES (SEQ ID NO: 60).

Cas9 Complexes with Guide RNAs

Some aspects of this disclosure provide complexes comprising any of the fusion proteins provided herein, and a guide RNA (e.g., a guide that targets A mutation) bound to a CAS9 domain (e.g., a dCas9, a nuclease active Cas9, or a Cas9 nickase) of fusion protein. These complexes are also termed ribonucleoproteins (RNPs). Any method for linking the fusion protein domains can be employed (e.g., ranging from very flexible linkers of the form (GGGS)$_n$ (SEQ ID NO: 271), (GGGGS)$_n$ (SEQ ID NO: 272), and (G)$_n$ to more rigid linkers of the form (EAAAK)$_n$ (SEQ ID NO: 273), (SGGS)$_n$ (SEQ ID NO: 197), SGSETPGTSESATPES (SEQ ID NO: 60) (see, e.g., Guilinger J P, Thompson D B, Liu DR. Fusion of catalytically inactive Cas9 to FokI nuclease improves the specificity of genome modification. Nat. Biotechnol. 2014; 32(6): 577-82; the entire contents are incorporated herein by reference) and (XP)$_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a (GGS)$_n$ motif (SEQ ID NO: 274), wherein n is 1, 3, or 7. In some embodiments, the Cas9 domain of the fusion proteins provided herein are fused via a linker comprising the amino acid sequence SGSETPGTSESATPES (SEQ ID NO: 60).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 4 or 5'-NAA-3'). In some embodiments, the guide nucleic acid (e.g., guide RNA) is complementary to a sequence in a gene of interest (e.g., a gene associated with a disease or disorder).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

In some embodiments, the guide RNA is designed to disrupt a splice site (i.e., a splice acceptor (SA) or a splice donor (SD)). In some embodiments, the guide RNA is designed such that the base editing results in a premature STOP codon. Tables 12A and 12B provide a non-exhaustive list of gRNA target sequences designed to disrupt a splice site or to result in a premature STOP codon. It should be appreciated that gRNA target sequence or targeting sequence encompasses a DNA sequence capable of hybridizing to the gRNA sequence (protospacer strand) complementary) and the complementary strand to the protospacer strand. In some embodiments, the targeting sequence is on the complementary strand.

TABLE 12A gRNAs: Splice Site and STOP Codons

| Gene | Description | Target sequence | SEQ ID NO: |
|---|---|---|---|
| VISTA | Exon 1 SD (pos6) | CCTTACCTAGGGACGCAGCC | 282 |
| | Exon 1 STOP (pos7) | GGATCCCCAGCGCCAGCTGC | 283 |
| | Exon 1 STOP (pos5) | AGCGCCAGCTGCCGGCCTCC | 284 |
| | Exon 1 STOP (pos4) | GCGCCAGCTGCCGGCCTCCA | 285 |
| | Exon 2 STOP (pos8) | CCTGGCTCAGCGCCACGGGC | 286 |
| | Exon 2 STOP (pos5) | GCTGCAGGTGCAGACAGGTG | 287 |
| | Exon 2 STOP (pos7) | GCGGTACCACGTCTTGTAGA | 288 |
| | Exon 3 SA (pos4) | TGCCTGTGGGAACAAACAGA | 289 |
| | Exon 3 SD (pos5) | CTTACTTTCACTATCCTGGG | 290 |
| | Exon 3 SD (pos8) | TCCCTTACTTTCACTATCCT | 291 |
| | Exon 3 STOP (pos5) | CTCCCAGGATAGTGAAAGTA | 292 |
| | Exon 4 SA (pos7) | TGATGTCTGAAAGGGCAGAG | 293 |
| | Exon 5 STOP (pos5) | TGCCCAGGAGCTGGTGCGGA | 294 |
| | Exon 6 SA (pos4) | TTGCTGCCACAGAACCAGAA | 295 |
| | Exon 6 STOP (pos4) | ATTCAAGGGATTGAAAACCC | 296 |
| | Exon 6 STOP (pos8) | ACCTGCCCAGGGGATACCCG | 297 |
| | Exon 6 STOP (pos7) | CAGCGGCAGCCTTCTGAGTC | 298 |
| | | | |
| TRAC | Exon 1 STOP 1 (pos5) | GCTACAAACAAGCTCATCTT | 299 |
| | Exon 1 STOP 2 (pos6) | CCAGCCAAGTACGTAAGTAG | 300 |
| | Exon 2 SA (pos9) | CTGGATATCTGTGGGACAAG | 301 |
| | Exon 2 SD | CTTACCTGGGCTGGGGAAGA | 302 |
| | Exon 4 SA | TTCGTATCTGTAAAACCAAG | 303 |
| | Exon 4 STOP | TTTCAAAACCTGTCAGTGAT | 304 |
| | Exon 4 STOP | TTCAAAACCTGTCAGTGATT | 305 |
| | | | |
| Tim-3 | Exon 2 SA (pos6) | GGACCCTGCATAGAGAGAGA | 306 |
| | Exon 2 STOP (pos5) | TGCCCCAGCAGACGGGCACG | 307 |
| | Exon 3 SD (pos5) | GTTACCTGGGCCATGTCCCC | 308 |
| | Exon 4 SD (pos5) | CTTACTGTTAGATTTATATC | 309 |
| | Exon 4 SD (pos4) | TTACTGTTAGATTTATATCA | 310 |
| | Exon 5 SA (pos5) | TTTGCTATGGAAACACAAAC | 311 |
| | Exon 5 STOP (pos8) | TCCATAGCAAATATCCACAT | 312 |
| | Exon 7 STOP (pos5) | GCAGCAACCCTCACAACCTT | 313 |
| | Exon 7 STOP (pos 4) | CAGCAACCCTCACAACCTTT | 314 |
| | | | |
| TIGIT | Exon 1 STOP (pos4) | AGGCAGGCTCCCCTCGCCTC | 315 |
| | Exon 2 STOP (5&8) | GGAGCAGCAGGACCAGCTTC | 316 |
| | Exon 2 SD (pos9) | CAGGAATACCTGAGCTTTCT | 317 |
| | Exon 3 STOP (pos7) | AGGTTCCAGATTCCATTGCT | 318 |
| | Exon 1 STOP | CTGGGCCCAGGGGCTGAGGC | 319 |
| | Exon 2 STOP | GATCGAGTGGCCCCAGGTCC | 320 |
| | | | |
| TGFbRII | Exon 1 SD (JMG79) | TCACCCGACTTCTGAACGTG | 321 |
| | Exon 3 SD (JMG83) | TTACCTGCCCACTGTTAGCC | 322 |
| | Exon 2 STOP (JMG80) | GAAGCCACAGGAAGTCTGTG | 323 |
| | Exon 3 STOP (JMG81) | ACTCCAGTTCCTGACGGCTG | 324 |
| | Exon 3 STOP (JMG82) | ACCTACAGGAGTACCTGACG | 325 |
| | Exon 4 STOP (JMG84) | TTCCCAGAGCACCAGAGCCA | 326 |
| | Exon 1 STOP (JMG85) | ACGTTCAGAAGTCGGGTGAG | 327 |
| | Exon 3 STOP (pos8) | TTCAGAGCAGTTTGAGACAG | 328 |
| | | | |
| RFXANK | Exon 2 SA (JMG8) | CCTGCTGGGAAACAGACAAC | 329 |
| | Exon 2 SD (JMG9) | CACTCACAGTCTAGGGTGGC | 330 |
| | Exon 2 STOP (pos8) | CAACCGGCAGCGAGGGAACG | 331 |
| | Exon 3 SA (pos7) | ACAGGGCTGGGGCAGGACAG | 332 |
| | Exon 3 STOP (pos8) | CATCCACCAGCTCGCAGCAC | 333 |

TABLE 12A-continued

| gRNAs: Splice Site and STOP Codons | | | |
|---|---|---|---|
| Gene | Description | Target sequence | SEQ ID NO: |
| | Exon 3 STOP (pos7) | ATCCACCAGCTCGCAGCACA | 334 |
| | Exon 3 STOP (pos6) | TCCACCAGCTCGCAGCACAG | 335 |
| | Exon 3 STOP (pos5) | CCACCAGCTCGCAGCACAGG | 336 |
| | Exon 4 SA (JMG10) | TGTCACCTGGCAGGAGGAGGC | 337 |
| | Exon 4 SA (pos6) | GTCACCTGGCAGGAGGAGGC | 338 |
| | Exon 5 SA (pos7) | GGCACCCTGCAGGGAGAAGA | 339 |
| | Exon 5 SA (JMG11) | GCACCCTGCAGGGAGAAGAA | 340 |
| | Exon 6 SA (pos4) | ATTCTGTCGTGGGTAGGGGC | 341 |
| | Exon 6 SA (JMG12) | CTCCATTCTGTCGTGGGTAG | 342 |
| | Exon 7 SA (pos8) | CCTCGGGCTGCAAAGGAGAG | 343 |
| | Exon 7 SA (pos5) | CGGGCTGCAAAGGAGAGGGG | 344 |
| | Exon 7 SD (pos6) | GCTGACCTTTCCGGTATCCC | 345 |
| | Exon 7 SD (pos5) | CTGACCTTTCCGGTATCCCA | 346 |
| | Exon 8 SA (pos8) | TGTTGCACTGAGATGGGGCA | 347 |
| | Exon 8 SA (pos9) | CTGTTGCACTGAGATGGGGC | 348 |
| | | | |
| PVRIG | Exon 1 STOP (pos7) | GCCCTGCAGCCCCCAGAACC | 349 |
| (CD112R) | Exon 1 SD (pos5) | CTCACCCGCAGTGACACACA | 350 |
| | Exon 1 STOP (pos8) | GCAGCACCCAGGGCAGGACC | 351 |
| | Exon 1 STOP (pos7) | CAGCACCCAGGGCAGGACCA | 352 |
| | Exon 2 SA (pos5) | GTCCCTGTGGAACAGCAGCA | 353 |
| | Exon 2 STOP (pos8) | GTGGGTTCAAGTTCGGATGG | 354 |
| | Exon 2 SD (pos 7) | GCCCCACCTGGGTCTGAGCT | 355 |
| | Exon 2 SD (pos8) | GGCCCCACCTGGGTCTGAGC | 356 |
| | Exon 2 SD (pos4) | CCACCTGGGTCTGAGCTGGG | 357 |
| | Exon 2 STOP (pos8) | AGGCCTCCCAGGAGCCCTCA | 358 |
| | Exon 2 STOP (pos4) | CTCCCAGGAGCCCTCAGGGA | 359 |
| | Exon 2 STOP (pos4) | CCCCCAGCTCACAGTCACCA | 360 |
| | Exon 3 SD (pos8) | GGTCTCACCGGTGCTTATGT | 361 |
| | Exon 3 STOP (pos9) | TGCTGCGCCGACATAAGCAC | 362 |
| | Exon 4 SA (pos8) | GGCAGGGCTGGGAGAGAGCA | 363 |
| | Exon 4 STOP (pos9) | CGAGAGCACGAGCATGGGTG | 364 |
| | Exon 4 STOP (pos6) | GAGCACGAGCATGGGTGAGG | 365 |
| | Exon 4 STOP (pos5) | AGCACGAGCATGGGTGAGGA | 366 |
| | Exon 4 STOP (pos4) | GCACGAGCATGGGTGAGGAG | 367 |
| | Exon 4 SD (pos5) | CTCACCCATGCTCGTGCTCT | 368 |
| | Exon 5 SA (pos6) | GGTGCCTGCGCGGGGGAAGG | 369 |
| | Exon 5 SA (pos5) | GTGCCTGCGCGGGGGAAGGA | 370 |
| | Exon 5 SA (pos9) | CTTGGTGCCTGCGCGGGGGA | 371 |
| | Exon 5 STOP (pos6) | GGCCCCAGGGCCCTGCCGCC | 372 |
| | Exon 5 STOP (pos9) | TCTACGCTCAGGCAGGGGAG | 373 |
| | Exon 5 STOP (pos4) | CCACCAGGACGGCCCCCCAT | 374 |
| | Exon 5 STOP (pos5) | AGGCCCAGGCGGCAGGGCCC | 375 |
| | Exon 5 STOP (pos4) | GGCCCAGGCGGCAGGGCCCT | 376 |
| | | | |
| PDCD1 | Exon 1 STOP 2 (pos9) | ACGACTGGCCAGGGCGCCTG | 377 |
| | Exon 1 STOP 4 (pos7) | CACCGCCCAGACGACTGGCC | 378 |
| | Exon 1 STOP (pos4) | CTACAACTGGGCTGGCGGCC | 379 |
| | Exon 1 SD | CACCTACCTAAGAACCATCC | 380 |
| | Exon 2 SA | GGAGTCTGAGAGATGGAGAG | 381 |
| | Exon 2 STOP 1 (pos8) | CAGCAACCAGACGGACAAGC | 382 |
| | Exon 2 STOP 2 (pos9) | GTGTCACACAACTGCCCAAC | 383 |
| | Exon 3 STOP 1 (pos8) | AGCCGGCCAGTTCCAAACCC | 384 |
| | Exon 3 STOP (pos7) | CAGTTCCAAACCCTGGTGGT | 385 |
| | Exon 3 STOP 2 (pos5) | CGGCCAGTTCCAAACCCTGG | 386 |
| | Exon 3 STOP (pos5) | GGACCCAGACTAGCAGCACC | 387 |
| | Exon 3 SD | GACGTTACCTCGTGCGGCCC | 388 |
| | Exon 4 SA | TCCCTGCAGAGAAACACACT | 389 |
| | Exon 4 SD | GAGACTCACCAGGGGCTGGC | 390 |
| | Exon 5 SA | CCTCCTTCTTTGAGGAGAAA | 391 |
| | Exon 2 STOP (pos 7) | GGGGTTCCAGGGCCTGTCTG | 392 |
| | Exon 3 SA | TTCTCTCTGGAAGGGCACAA | 393 |
| | Exon 5 STOP 1 (pos 8) | CCAGTGGCGAGAGAAGACCC | 394 |
| | Exon 5 STOP 2 (pos 5) | TGCCCAGCCACTGAGGCCTG | 395 |
| | Exon 1 STOP 1 (pos8) | CGACTGGCCAGGGCGCCTGT | 396 |
| | Exon 1 STOP 3 (pos6) | ACCGCCCAGACGACTGGCCA | 397 |
| | | | |
| Lag3 | Exon 1 STOP (pos8) | GTTTCTGCAGCCGCTTTGGG | 398 |
| | Exon 1 SD (pos4) | TTACCTGGAGCCACCCAAAG | 399 |
| | Exon 2 SA (pos4) | TCACTAGGTGAGCAAAAGAG | 400 |
| | Exon 2 STOP (pos8) | GCCTCTCCAGCCAGGGGCTG | 401 |
| | Exon 2 STOP (pos 6) | CTTGGCAGCATCAGCCAGAC | 402 |
| | Exon 3 SA (pos4) | CCACTGGGCGGGAAAGAGAA | 403 |
| | Exon 3 SD (pos6) | ACATACTCGAGGCCTGGCCC | 404 |
| | Exon 3 STOP (pos5) | CCTGCAGCCCCGCGTCCAGC | 405 |
| | Exon 3 STOP (pos7) | CGCGTCCAGCTGGATGAGCG | 406 |

TABLE 12A-continued

| Gene | Description | Target sequence | SEQ ID NO: |
|------|-------------|-----------------|------------|
| | | qRNAs: Splice Site and STOP Codons | |
| | Exon 3 STOP (pos6) | TGGGCCAGGCCTCGAGTATG | 407 |
| | Exon 4 SD (pos4) | GGGAGTTACCCAGAACAGTG | 408 |
| | Exon 4 STOP (pos8) | CCTGCCCCAAGTCAGCCCCA | 409 |
| | Exon 4 STOP (pos9) | GCCAGGGCCGAGTCCCTGTC | 410 |
| | Exon 4 STOP (pos8) | CCAGGGCCGAGTCCCTGTCC | 411 |
| | Exon 4 STOP (pos4) | GCCCCAGGGCCCAGAGTCCA | 412 |
| | Exon 5 STOP (pos9) | ATGTGAGCCAGGCCCAGGCT | 413 |
| | Exon 5 STOP (pos 8) | GAGGAGTCCACTTGGCAGTG | 414 |
| | Exon 6 SA (pos7) | GAGTCACTGAAAAGAGTAGA | 415 |
| | Exon 6 STOP (pos6) | CTGGACAAGAACGCTTTGTG | 416 |
| | Exon 6 STOP (pos7) | CCATCCCAGAGGAGTTTCTC | 417 |
| | Exon 6 STOP (pos4) | TGGCAATGCCAGCTGTACCA | 418 |
| | Exon 6 STOP (pos4) | TACCAGGGGGAGAGGCTTCT | 419 |
| | Exon 6 STOP (pos8) | GGCATTGCCAAGGCTGGGAA | 420 |
| | Exon 7 SA (pos6) | GGCACCTATGGAGAAAGTAC | 421 |
| | Exon 7 STOP (pos4) | AGACAGGTGAGCCAGGGACA | 422 |
| | Exon 7 SD (pos7) | GGCTCACCTGTCTTCTCCAA | 423 |
| | Exon 8 SA (pos8) | GTCGCCACTGTGAGAAGAGA | 424 |
| | Exon 8 STOP (pos8) | GCAGGCTCAGAGCAAGATAG | 425 |
| | Exon 8 STOP (pos8) | GCTGGAGCAAGAACCGGAGC | 426 |
| CTLA-4 | Exon 1 SD (pos 6) | ACTCACCTTTGCAGAAGACA | 427 |
| | Exon 1 SD | CACTCACCTTTGCAGAAGAC | 428 |
| | Exon 1 STOP (pos5) | AGGGCCAGGTCCTGGTAGCC | 429 |
| | Exon 2 STOP | GGCCCAGCCTGCTGTGGTAC | 430 |
| | Exon 2 STOP (pos 8) | GCTTCGGCAGGCTGACAGCC | 431 |
| | Exon 2 STOP | TATCCAAGGACTGAGGGCCA | 432 |
| | Exon 2 STOP | GGAACCCAGATTTATGTAAT | 433 |
| | Exon 2 SD | GCTCACCAATTACATAAATC | 434 |
| | Exon 2 SD | CTCACCAATTACATAAATCT | 435 |
| | Exon 1 STOP | CTCAGCTGAACCTGGCTACC | 436 |
| Chi3l1 | Exon 1 STOP (pos8) | GGCGTCTCAAACAGGTATCT | 437 |
| | Exon 1 SA (pos7) | CAAAGCCTGAAGAGAAATCC | 438 |
| | Exon 3 SA (pos6) | AGAGCCTGAAGGAGAAGTCT | 439 |
| | Exon 3 STOP (pos4) | TCCCAGTACCGGGAAGGCGA | 440 |
| | Exon 4 SA (pos6) | GGTTCCTGTGGAGCACAGGG | 441 |
| | Exon 4 SA (pos9) | TGGGGTTCCTGTGGAGCACA | 442 |
| | Exon 6 SA (pos8) | TCATTTCCTAGATGGGAGAC | 443 |
| | Exon 6 SA (pos4) | TTCCTAGATGGGAGACAGGC | 444 |
| | Exon 8 SA (pos9) | CCAGGTGTCTGAGGAGGAAG | 445 |
| | Exon 8 SA (pos5) | GTGTCTGAGGAGGAAGGGGA | 446 |
| | Exon 9 SA (pos6) | TAGTCCTGGGTGGGGTAGGG | 447 |
| | Exon 9 SA (pos5) | AGTCCTGGGTGGGGTAGGGT | 448 |
| | Exon 9 SD (pos6) | CATTACCTCATAGTAGGCAA | 449 |
| | Exon 9 SD (pos7) | CCATTACCTCATAGTAGGCA | 450 |
| | Exon 10 SA (pos7) | ACAGATCTGAGCAGATAACA | 451 |
| | Exon 10 STOP (pos 7) | TCCTACCCACTGGTTGCCCT | 452 |
| | Exon 11 STOP (pos7) | AGGTGCAGTACCTGAAGGAC | 453 |
| | Exon 11 STOP (pos5) | CAGGCAGCTGGCGGGCGCCA | 454 |
| | Exon 11 STOP (pos7) | GACTTCCAGGGCTCCTTCTG | 455 |
| CD96 | Exon 1 STOP (pos5) | CATCCAGATACATTTTGTCA | 456 |
| | Exon 2 STOP (pos5) | ACCTGCCAAACACAGACAGT | 457 |
| | Exon 2 STOP (pos7) | CGTGCAGATGCAATGGTCCA | 458 |
| | Exon 3 SA (pos6) | TGTAACTGTAACAAAACATA | 459 |
| | Exon 3 SD (pos6) | ACTTACCACCGACCATGCAT | 460 |
| | Exon 5 SD (pos5) | CTTACCAAAAACCTTGACTG | 461 |
| | Exon 5 STOP (pos6) | CCAGTCCAAATCTTCGATGA | 462 |
| | Exon 5 STOP (pos7) | CAGTCCAAATCTTCGATGAT | 463 |
| | Exon 7 STOP (pos4) | AAACCATGTGATATTTGCTT | 464 |
| | Exon 8 STOP (pos6) | ATGTTCCACACTTTATTTCC | 465 |
| | Exon 10 SD (pos4) | TCACGTTGAGGAGTGGTGTT | 466 |
| | Exon 13 SA (pos7) | CATTGTCTAGGGATATAAAG | 467 |
| | Exon 13 SA (pos8) | ACATTGTCTAGGGATATAAA | 468 |
| | Exon 13 SA (pos9) | GACATTGTCTAGGGATATAA | 469 |
| | Exon 14 STOP (pos4) | TGGCCAGGACATTCCATCTT | 470 |
| | Exon 15 SA (pos6) | CCATTCTAGGAACAAAATAT | 471 |
| Cblb | Exon 1 STOP | GAGCTTCCAAGTCTTCTCCA | 472 |
| | Exon 1 STOP (JMG44) | TCCCCGAAAAGGTCGAATTT | 473 |
| | Exon 2 STOP | ATGAAGAACAGTCACAGGAC | 474 |
| | Exon 3 SA | GATTTCGTCTGTAGGCACAA | 475 |
| | Exon 4 SD | TAAACTTACCTGAAACAGCC | 476 |
| | Exon 4 STOP | ATTCAGACAGTGCCTTCATG | 477 |
| | Exon 6 STOP | GTTGCACTCGATTGGGACAG | 478 |

TABLE 12A-continued

| Gene | Description | Target sequence | SEQ ID NO: |
|------|-------------|-----------------|------------|
| | Exon 6 STOP | TTATTTCAAGCCCTGATTGA | 479 |
| | Exon 7 SD | TTACCTGTGTAACTTTTATA | 480 |
| | Exon 8 SA (pos8) | ATTGTTCCTGGAATTTGGGG | 481 |
| | Exon 8 SD (JMG48) | ATTATACCTGCCATGCCGTA | 482 |
| | Exon 8 SA (pos 5) (JMG46) | GTTCCTGGAATTTGGGGAGG | 483 |
| | Exon 8 STOP (JMG47) | CTGCCATGCCGTAAGGCAAG | 484 |
| | Exon 10 SD (JMG49) | TCTACCTTTGGTGAACCCGT | 485 |
| | Exon 11 SD (JMG50) | CTTACCTTAGCTCCTTCTAA | 486 |
| | Exon 11 STOP | GGGATGTCGACTCCTAGGGG | 487 |
| | Exon 11 STOP | CGAGGGCACCATGCTTCAAG | 488 |
| | Exon 12 SD | AAACTCACTTTATGCTAGGG | 489 |
| | Exon 12 SD (JMG51) | CTCACTTTATGCTAGGGAGG | 490 |
| | Exon 16 SA (JMG52) | CTTCACCTGCATTTAAAGAA | 491 |
| | Exon 4 STOP (JMG45) | CCACCAGATTAGCTCTGGCC | 492 |
| | Exon 10 SD (pos4) | CTACCTTTGGTGAACCCGTT | 493 |
| BTLA | Exon 1 STOP (pos6) | ATGTTCCAGATGTCCAGATA | 494 |
| | Exon 1 STOP (pos5) | TGTTCCAGATGTCCAGATAT | 495 |
| | Exon 2 STOP (pos8) | AGATAGACAAACAAGTTGGA | 496 |
| | Exon 2 STOP (pos9) | AGCTTGCACCAAGTCACATG | 497 |
| | Exon 3 SD (pos6) | ACCCACCTTGGTGCCTTCTC | 498 |
| B2M (BE) | Exon 1 SD | ACTCACGCTGGATAGCCTCC | 499 |
| | Exon 2 SA (pos9) | TGGAGTACCTGAGGAATATC | 500 |
| | Exon 2 STOP (pos6) | TTACCCCACTTAACTATCTT | 501 |
| | Exon 3 SA | TCGATCTATGAAAAAGACAG | 502 |
| | Exon 2 STOP | TACCCCACTTAACTATCT | 503 |
| B2M (ABE) | Exon 1 SD 1 (pos 5) | ACTCACGCTGGATAGCCTCC | 504 |
| | Exon 2 SA (pos 4) | CTCAGGTACTCCAAAGATTC | 505 |
| | Exon 2 SD (pos 4) | CTTACCCCACTTAACTATCT | 506 |
| TET2 | Exon 1 STOP 1 (pos 8) | CATTTGCCAGACAGAACCTC | 507 |
| | Exon 1 STOP 2 (pos 4) | AAACAAGACCAAAAGGCTAA | 508 |
| | Exon 1 STOP 3 (pos 7) | GTAAGCCAAGAAAGAAATCC | 509 |
| | Exon 1 STOP 4 (pos 5) | GCTTCAGATTCTGAATGAGC | 510 |
| | Exon 1 STOP 5 (pos 7) | TTAAAACAAAATGAAATGAA | 511 |
| | Exon 1 STOP 6 (pos 7) | GTTCCTCAGCTTCCTTCAGA | 512 |
| | Exon 1 STOP 7 (pos 8) | CAAAGAGCAAGAGATTCTGA | 513 |
| | Exon 1 STOP 8 (pos 7) | AAAGAGCAAGAGATTCTGAA | 514 |
| | Exon 1 STOP 9 (pos 4) | ACACAGCACTATCTGAAACC | 515 |
| | Exon 1 STOP 10 (pos 5) | CACCCAGAAAACAACACAGC | 516 |
| | Exon 1 STOP 11 (pos 4) | TACCAAGTTGAAATGAATCA | 517 |
| | Exon 1 STOP 12 (pos 7) | ATGAATCAAGGGCAGTCCCA | 518 |
| | Exon 1 STOP 13 (pos 5) | AGGGCAGTCCCAAGGTACAG | 519 |
| | Exon 1 STOP 14 (pos 5) | GTTCCAAAAACCCTCACACC | 520 |
| | Exon 1 STOP 15 (pos 5) | GAAACAGCACTTGAATCAAC | 521 |
| | Exon 1 STOP 16 (pos 5) | ATTACAAATAAAGAATAAAG | 522 |
| | Exon 1 STOP 17 (pos 8) | TAATGTCCAAATGGGACTGG | 523 |
| | Exon 1 STOP 18 (pos 6) | CAAAGCAAGATCTTCTTCAC | 524 |
| | Exon 1 STOP 19 (pos 5) | ACAACAAGCTTCAGTTCTAC | 525 |
| | Exon 1 STOP 20 (pos 6) | CTGCGCAACTTGCTCAGCAA | 526 |
| | Exon 1 STOP 21 (pos 5) | CACTCAGACCCCTCCCCAGA | 527 |
| | Exon 1 STOP 22 (pos 6) | TTTTTCCATGTTTTGTTTTC | 528 |
| | Exon 1 SD (pos 4) | TTACCTACACATCTGCAAGA | 529 |
| | Exon 3 SD (pos 8) | ACACTTACCCACTTAGCAAT | 530 |
| | Exon 7 STOP (pos 5) | CATGCAGAATGGCAGCACAT | 531 |
| | Exon 8 STOP 1 (pos 6) | AAGCTCAGGAGGAGAAAAAA | 532 |
| | Exon 8 STOP 2 (pos 8) | CGCAAGCCAGGCTAAACAGT | 533 |
| | Exon 9 STOP 1 (pos 8) | TTCTCCCCAGTCTCAGCCGA | 534 |
| | Exon 9 STOP 2 (pos 5) | TGGTCAGGAAAAGCAGCCAT | 535 |
| | Exon 9 STOP 3 (pos 7) | CTAGTCCAGGGTGTGGCTTC | 536 |
| Spry1 | Exon 1 STOP 1 | CCCCAAAATCAACATGGCAG | 537 |
| | Exon 1 STOP 2 | TGTGATCCAGCAGCCTTCTT | 538 |
| | Exon 1 STOP 3 | GACCAGATCAAGGCCATAAG | 539 |
| | Exon 1 STOP 4 | CAAGACAAGAAAAGCATGAA | 540 |
| | Exon 1 STOP 5 | CTGAACAGGGACTGTTAGGA | 541 |
| Spry2 | Exon 1 STOP 1 | CCAGAGCTCAGAGTGGCAAC | 542 |
| | Exon 1 STOP 2 | TTGCTGCAGACGCCCCGTGA | 543 |
| | Exon 1 STOP 3 | CTGCAGACGCCCCGTGACGG | 544 |
| | Exon 1 STOP 4 | CGACAAGCAGTGCCTTTGCT | 545 |
| | Exon 1 STOP 5 | GCCCAGAACGTGATTGACTA | 546 |
| | Exon 1 STOP 6 | TGTGCCAGGGGTGTTATGAC | 547 |

TABLE 12A-continued

| gRNAs: Splice Site and STOP Codons | | | |
|---|---|---|---|
| Gene | Description | Target sequence | SEQ ID NO: |
| | Exon 1 STOP 7 | CAGATCCAGTCTGATGGCAG | 548 |
| | Exon 1 STOP 8 | TGTACACGATGGTCAGCCAT | 549 |
| CIITA | Exon 1 SD (pos 6) | TTTTACCTTGGGGCTCTGAC | 550 |
| | Exon 1 STOP 1 (pos 6) | AGCCCCAAGGTAAAAAGGCC | 551 |
| | Exon 1 STOP 2 (pos 7) | GAGCCCCAAGGTAAAAAGGC | 552 |
| | Exon 2 STOP 1 (pos 8) | CAGCTCACAGTGTGCCACCA | 553 |
| | Exon 2 STOP 2 (pos 7) | TATGACCAGATGGACCTGGC | 554 |
| | Exon 4 STOP 1 (pos 8) | ACTGGACCAGTATGTCTTCC | 555 |
| | Exon 4 STOP 2 (pos 8) | TGTCTTCCAGGACTCCCAGC | 556 |
| | Exon 7 STOP 1 (pos 7) | TTCAACCAGGAGCCAGCCTC | 557 |
| | Exon 7 STOP 2 (pos 4) | GACCAGATTCCCAGTATGTT | 558 |
| | Exon 7 SD (pos 8) | TAACATACTGGGAATCTGGT | 559 |
| | Exon 8 SA (pos 8) | AAAGGCACTGCAAGAGACAA | 560 |
| | Exon 8 STOP (pos 8) | CTCTGGCAAATCTCTGAGGC | 561 |
| | Exon 9 STOP 1 (pos 4) | AGCCAAGTACCCCCTCCCAG | 562 |
| | Exon 9 STOP 2 (pos 7) | ACCTCCCGAGCAAACATGAC | 563 |
| | Exon 9 SD (pos 6) | CCTTACCTGTCATGTTTGCT | 564 |
| | Exon 10 SA (pos 5) | TGCTCTGGAGATGGAGAAGC | 565 |
| | Exon 10 STOP 1 (pos 7) | CCCACCCAATGCCCGGCAGC | 566 |
| | Exon 10 STOP 2 (pos 4) | AGGCCATTTTGGAAGCTTGT | 567 |
| | Exon 11 SA (pos 8) | ACCGGCTCTGCAAAGGCCAG | 568 |
| | Exon 11 STOP 1 (pos 6) | TGGTGCAGGCCAGGCTGGAG | 569 |
| | Exon 11 STOP 3 (pos 7) | GAACGGCAGCTGGCCCAAGG | 570 |
| | Exon 11 STOP 4 (pos 5) | GGCCCAAGGAGGCCTGGCTG | 571 |
| | Exon 11 STOP 5 (pos 5) | GACACGAGTGATTGCTGTGC | 572 |
| | Exon 11 STOP 5 (pos 6) | CTGGTCAGGGCAAGAGCTAT | 573 |
| | Exon 11 STOP 5 (pos 8) | GGGCCCACAGCCACTCGTGG | 574 |
| | Exon 11 STOP 6 (pos 4) | TTCCAGAAGAAGCTGCTCCG | 575 |
| | Exon 11 STOP 7 (pos 8) | CCTGGTCCAGAGCCTGAGCA | 576 |
| | Exon 11 STOP 8 (pos 8) | CAGACATCAAAGTACCCTAC | 577 |
| | Exon 11 STOP 9 (pos 5) | ACATCAAAGTACCCTACAGG | 578 |
| | Exon 11 STOP 10 (pos 4) | CGCCCAGGTCCTCACGTCTG | 579 |
| | Exon 11 STOP 11 (pos 8) | CTTAGTCCAACACCCACCGC | 580 |
| | Exon 11 STOP 12 (pos 8) | CCTCCTGCAATGCTTCCTGG | 581 |
| | Exon 11 STOP 13 (pos 8) | GAGCCAGCCACAGGGCCCCC | 582 |
| | Exon 11 STOP 14 (pos 6) | GGAAGCAGAAGGTGCTTGCG | 583 |
| | Exon 11 STOP 15 (pos 6) | GGCTGCAGCCGGGGACACTG | 584 |
| | Exon 11 STOP 16 (pos 4) | CTGCCAAATTCCAGCCTCCT | 585 |
| | Exon 11 STOP 17 (pos 8) | GGCGGGCCAAGACTTCTCCC | 586 |
| | Exon 12 STOP 1 (pos 6) | AGACTCAGAGGTGAGAGGAG | 587 |
| | Exon 14 SA (pos 4) | AGCCTAGGAGGCAAAGAGCA | 588 |
| | Exon 14 STOP 1 (pos 5) | CCCCCAGGCTTTCCCCAAAC | 589 |
| | Exon 14 SD (pos 4) | TCACTCCAGATGCTGCAGGG | 590 |
| | Exon 15 SA (pos 4) | AGGCTGCAGGTGGAATCAGA | 591 |
| | Exon 15 STOP 1 (pos 8) | CTTCCCCCAGCTGAAGTCCT | 592 |
| | Exon 15 SD (pos 7) | CACTCACTTGAGGGTTTCCA | 593 |
| | Exon 16 SA (pos 5) | CAGACTGCGGGGACACAGTG | 594 |
| | Exon 16 SD 1 (pos 8) | CCACTCACCTTAGCCTGAGC | 595 |
| | Exon 16 SD 2 (pos 7) | CACTCACCTTAGCCTGAGCA | 596 |
| | Exon 17 SA (pos 8) | GTACAAGCTGTCGGAAACAG | 597 |
| | Exon 17 SD 1 (pos 8) | ACACTCACTCCATCACCCGG | 598 |
| | Exon 17 SD 2 (pos 7) | CACTCACTCCATCACCCGGA | 599 |
| | Exon 18 STOP (pos 5) | CGTCCAGTACAACAAGTTCA | 600 |
| | Exon 19 SA 1 (pos 8) | CCACATCCTGCAAGGGGGGA | 601 |
| | Exon 19 SA 2 (pos 7) | CACATCCTGCAAGGGGGGAT | 602 |
| | Exon 19 STOP 1 (pos 8) | TGGGCGTCCACATCCTGCAA | 603 |
| | Exon 19 STOP 2 (pos 7) | GGGCGTCCACATCCTGCAAG | 604 |
| | Exon 19 STOP 3 (pos 6) | GGCGTCCACATCCTGCAAGG | 605 |
| | Exon 19 STOP 4 (pos 5) | GCGTCCACATCCTGCAAGGG | 606 |
| CD7 | Exon 1 STOP (pos 4) | GCCCAAGGTAAGAGCTTCCC | 607 |
| | Exon 1 SD 1 (pos 8) | GCTCTTACCTTGGGCAGCCA | 608 |
| | Exon 1 SD 2 (pos 9) | AGCTCTTACCTTGGGCAGCC | 609 |
| | Exon 2 SA 1 (pos 8) | TGCACCTCTGGGGAGGACCT | 610 |
| | Exon 2 SA 2 (pos 9) | CTGCACCTCTGGGGAGGACC | 611 |
| | Exon 2 STOP 1 (pos 7) | CGCCTGCAGCTGTCGGACAC | 612 |
| | Exon 2 STOP 2 (pos 8) | CACCTGCCAGGCCATCACGG | 613 |
| | Exon 2 SD 1 (pos 6) | CCCTACCTGTCACCAGGACC | 614 |
| | Exon 2 SD 2 (pos 5) | CCTACCTGTCACCAGGACCA | 615 |
| | Exon 3 SA (pos 4) | CCTCTGAGAAGGAAAAAAGA | 616 |
| | Exon 3 STOP 1 (pos9) | CAGAGGAACAGTCCCAAGGA | 617 |
| CD33 | Exon 1 SD 1 (pos 7 | CACTCACCTGCCCACAGCAG | 618 |
| | Exon 1 SD 2 (pos 8) | CCACTCACCTGCCCACAGCA | 619 |
| | Exon 1 SD (pos 9) | GCCACTCACCTGCCCACAGC | 620 |

TABLE 12A-continued

| Gene | Description | Target sequence | SEQ ID NO: |
|---|---|---|---|
| | Exon 2 SA 1 (pos 8) | AGGGCCCCTGTGGGGAAACG | 621 |
| | Exon 2 SA 2 (pos 7) | GGGCCCCTGTGGGGAAACGA | 622 |
| | Exon 2 STOP 1 (pos 8) | GCAAGTGCAGGAGTCAGTGA | 623 |
| | Exon 2 STOP 2 (pos 6) | CGGAACCAGTAACCATGAAC | 624 |
| | Exon 2 STOP 3 (pos 5) | GGAACCAGTAACCATGAACT | 625 |
| | Exon 2 STOP 4 (pos 4) | GAACCAGTAACCATGAACTG | 626 |
| | Exon 2 STOP 5 (pos 8) | GCTAGATCAAGAAGTACAGG | 627 |
| | Exon 2 STOP 6 (pos 8) | AGAAGTACAGGAGGAGACTC | 628 |
| | Exon 3 SA 1 (pos 6) | CAAGTCTAGTGAGGAGAAAG | 629 |
| | Exon 3 SA 2 (pos 5) | AAGTCTAGTGAGGAGAAAGA | 630 |
| | Exon 3 SA 3 (pos 4) | AGTCTAGTGAGGAGAAAGAG | 631 |
| | Exon 3 STOP 1 (pos 7) | ACAGGCCCAGGACACAGAGC | 632 |
| | Exon 3 STOP 2 (pos 7) | ACCTGTCAGGTGAAGTTCGC | 633 |
| | Exon 3 SD 1 (pos 6) | ACTTACAGGTGACGTTGAGC | 634 |
| | Exon 4 SA 1 (pos 6) | AACATCTAGGAGAGGAAGAG | 635 |
| | Exon 4 STOP 1 (pos 7) | GTTCCACAGAACCCAACAAC | 636 |
| | Exon 4 SD 1 (pos 7) | TTCCTACCTGAGCCATCTCC | 637 |
| | Exon 5 SD (pos 8) | ATGCTCACATGAAGAAGATG | 638 |
| | Exon 5 STOP 1 (pos 7) | GGGAAACAAGAGACCAGAGC | 639 |
| | Exon 6 SA 1 (pos 6) | TCACTCTGATGGGAGACACC | 640 |
| | Exon 6 SA 2 (pos 5) | CACTCTGATGGGAGACACCA | 641 |
| | Exon 6 SA 1 (pos 4) | TTTCTTATGGAGAGGAAAGA | 642 |
| CD52 | Exon 1 STOP (pos 4) | GTACAGGTAAGAGCAACGCC | 643 |
| | Exon 1 SD (pos7) | CTCTTACCTGTACCATAACC | 644 |
| | Exon 1 SD (pos 4) | TTACCTGTACCATAACCAGG | 645 |
| | Exon 2 SA (pos 6) | TGTATCTGTAGGAGGAGAAG | 646 |
| | Exon 2 SA (pos 5) | GTATCTGTAGGAGGAGAAGT | 647 |
| | Exon 2 STOP (pos 7) | CAGATACAAACTGGACTCTC | 648 |
| CD123 | Exon 1 SD (pos 6) | TCTTACCTTCCTTCGTTTGC | 649 |
| | Exon 2 SA 1 (pos 8) | TTTGGATCTAAAACGGTGAC | 650 |
| | Exon 2 SA 2 (pos 4) | GATCTAAAACGGTGACAGGT | 651 |
| | Exon 2 STOP 1 (pos 8) | AAAGGCTCAGCAGTTGACCT | 652 |
| | Exon 2 SD (pos 6) | ATTTACCGGCATAGAATAGT | 653 |
| | Exon 3 SA (pos 8) | TCACTGCCTAAGAGAGACAT | 654 |
| | Exon 3 STOP 1 (pos 6) | AGGATCCACGTGGAGAATGG | 655 |
| | Exon 3 STOP 2 (pos 5) | GGATCCACGTGGAGAATGGT | 656 |
| | Exon 3 SD (pos 6) | TCTCACTGTTCTCAGGGAAG | 657 |
| | Exon 4 STOP 1 (pos 6) | CCTGCCCAAGGCTTCCCACC | 658 |
| | Exon 4 STOP 2 (pos 5) | CTGCCCAAGGCTTCCCACCT | 659 |
| | Exon 5 SA 1 (pos 6) | GCCTGCTGCGGTAAGCGGTA | 660 |
| | Exon 5 STOP 1 (pos 7) | GATGCTCAGGGAACACGTAT | 661 |
| | Exon 5 STOP 2 (pos 5) | TTCTCAAAGTTCCCACATCC | 662 |
| | Exon 5 STOP 3 (pos 4) | TCACAGATTGGTGAGTAGCC | 663 |
| | Exon 7 SD (pos 5) | CTCACCTGTTCTGTGATTAC | 664 |
| | Exon 8 STOP 1 (pos 7) | TCCTTCCAGCTACTCAATCC | 665 |
| | Exon 8 STOP 2 (pos 8) | CACAGTACAAATAAGAGCCC | 666 |
| | Exon 8 STOP 3 (pos 6) | CCCCCCAGCGCTTCGGTGAG | 667 |
| | Exon 8 STOP 4 (pos 5) | CCCCCAGCGCTTCGGTGAGT | 668 |
| | Exon 8 SD (pos 8) | CCACTCACCGAAGCGCTGGG | 669 |
| | Exon 10 SA (pos 4) | TACCTCGGAGGAAAGAGAAA | 670 |
| | Exon 10 STOP (pos 8) | CAGCTTCCAAAACGACAAGC | 671 |
| | Exon 10 SD (pos 7) | AACATACCAGCTTGTCGTTT | 672 |
| | Exon 11 SA 1 (pos 8) | AGACCACCTGCAGAGACGAG | 673 |
| | Exon 11 SA 2 (pos 5) | CCACCTGCAGAGACGAGAGG | 674 |
| TRBC1 | Exon 1 STOP 1 (pos 8) | CCACACCCAAAAGGCCACAC | 675 |
| | Exon 1 STOP 2 (pos 5) | CCCACCAGCTCAGCTCCACG | 676 |
| | Exon 1 STOP 3 (pos 7) | CGCTGTCAAGTCCAGTTCTA | 677 |
| | Exon 1 STOP 4 (pos 6) | GCTGTCAAGTCCAGTTCTAC | 678 |
| | Exon 1 STOP 5 (pos 5) | CACCCAGATCGTCAGCGCCG | 679 |
| | Exon 1 SD (pos 8) | CCACTCACCTGCTCTACCCC | 680 |
| | Exon 2 SA (pos 8) | CCACAGTCTGAAAGAAAGCA | 681 |
| | Exon 3 SA (pos 5) | GACACTGTTGGCACGGAGGA | 682 |
| | Exon 3 SD (pos 4) | TTACCATGGCCATCAACACA | 683 |
| TRBC2 | Exon 1 STOP 1 (pos 8) | CCACACCCAAAAGGCCACAC | 684 |
| | Exon 1 STOP 2 (pos 5) | CCCACCAGCTCAGCTCCACG | 685 |
| | Exon 1 STOP 3 (pos 7) | CGCTGTCAAGTCCAGTTCTA | 686 |
| | Exon 1 STOP 4 (pos 6) | GCTGTCAAGTCCAGTTCTAC | 687 |
| | Exon 1 STOP 5 (pos 5) | CACCCAGATCGTCAGCGCCG | 688 |
| | Exon 2 SA (pos 8) | CCACAGTCTGAAAGAAAACA | 689 |
| | Exon 2 SA (pos 7) | CACAGTCTGAAAGAAAACAG | 690 |
| | Exon 3 SD (pos 4) | TTACCATGGCCATCAGCACG | 691 |
| | Exon 1 SD (pos 8) | CCACTCACCTGCTCTACCCC | 692 |

TABLE 12A-continued

| gRNAs: Splice Site and STOP Codons | | | |
|---|---|---|---|
| Gene | Description | Target sequence | SEQ ID NO: |
| CISH | Exon 1 STOP | TCTGCGTTCAGGGGTAAGCG | 693 |
| | Exon 1 SD | GCGCTTACCCCTGAACGCAG | 694 |
| | Exon 2 STOP 2 | GACTGGGCAGCGGCCCCTGT | 695 |
| | Exon 2 STOP 1 | GGACTGGGCAGCGGCCCCTG | 696 |
| | Exon 2 STOP 3 | GTCATGCAGCCCTTGCCTGC | 697 |
| | Exon 2 STOP 4 | TCATGCAGCCCTTGCCTGCT | 698 |
| | Exon 2 STOP 5 | CATGCAGCCCTTGCCTGCTG | 699 |
| | Exon 2 SD 1 | CTCACCAGATTCCCGAAGGT | 700 |
| | Exon 2 SD 2 | CAGACTCACCAGATTCCCGA | 701 |
| | Exon 3 SA 1 (pos 4) | AGCCTAGGCAAGTGCAGAGG | 702 |
| | Exon 3 SA 2 (pos 5) | CAGCCTAGGCAAGTGCAGAG | 703 |
| | Exon 3 SA 3 (pos 7) | ACCAGCCTAGGCAAGTGCAG | 704 |
| | Exon 3 STOP 1 (pos 8) | TGGAACCCCAATACCAGCCT | 705 |
| | Exon 3 STOP 2 (pos 7) | CACCTGCAGAAGATGCCAGA | 706 |
| ACAT1 | Exon 1 SD 1 (pos 7) | CGCTCACCTGCACCAGCCTC | 707 |
| | Exon 3 SA (pos 5) | CTTCCTGGCAAGACACAAGA | 708 |
| | Exon 3 STOP (pos 5) | AATTCAGGGAGCCATTGAAA | 709 |
| | Exon 3 SD (pos 8) | CTACTGACCTGCCTTTTCAA | 710 |
| | Exon 5 STOP (pos 7) | GCCTCTCAAAGTCTTATGTG | 711 |
| | Exon 7 STOP (pos 4) | TTCCCATGCTGCTTTACTTC | 712 |
| | Exon 8 STOP (pos 8) | TTTAGGTCAACCAGATGTAG | 713 |
| | Exon 9 SA (pos 9) | TGTGCCTGAAAGCAAAAATG | 714 |
| | Exon 9 SD (pos 4) | TTACCTACTATTCTTGCCAG | 715 |
| | Exon 10 SA (pos 6) | AAATGCTGTTTAAAAAAAGG | 716 |
| | Exon 11 STOP (pos 4) | CCCCAAAAAGTGAATATCAA | 717 |
| Cyp11a1 | Exon 1 STOP 1 (pos 4) | GTCCAGAATTTCCAGAAGTA | 718 |
| | Exon 2 SA 1 (pos 4) | TCCCTGGAGGGGTGGGGGAG | 719 |
| | Exon 2 SD 1 (pos 4) | TCACTTCAACAGGACTCCTA | 720 |
| | Exon 3 SD 1 (pos 6) | CCTTACACTCAAAGGCAAAG | 721 |
| | Exon 4 SA (pos 5) | ATGGCTGCAGGGAGAGGAAG | 722 |
| | Exon 4 STOP 1 (pos 8) | GGAGCGCCAGGGGATGCTGG | 723 |
| | Exon 4 STOP 2 (pos 8) | TCACGTCCCATGCAGCCACA | 724 |
| | Exon 6 SA (pos 8) | TGGACGTCTGGTGGGGAGTA | 725 |
| | Exon 8 STOP 1(pos 6) | ACTCACATTGATGAGGAAGA | 726 |
| | Exon 9 SA (pos 7) | CAGCATCTGAGAAAGGCAGA | 727 |
| | Exon 9 STOP 1 (pos 5) | AATCCAACACCTCAGCGATG | 728 |
| | Exon 9 STOP 2 (pos 4) | ATCCAACACCTCAGCGATGT | 729 |
| GATA3 | Exon 1 STOP 1 (pos 8) | CGCGGCGCAGTACCCGCTGC | 730 |
| | Exon 1 SD 1 (pos 7) | CACTCACCGTGGTGGGTCGG | 731 |
| | Exon 1 SD 2 (pos 6) | ACTCACCGTGGTGGGTCGGA | 732 |
| | Exon 2 SA 1 (pos 8) | TGGCTCCCTGTGGGGCAACG | 733 |
| | Exon 2 STOP 2 (pos 5) | GATTCCAGGGGGAGGCGGTG | 734 |
| | Exon 2 SD 1 (pos 8) | GCTCCTACCTGTGCTGGACC | 735 |
| | Exon 3 STOP 1 (pos 7) | TCGCCGCCACAGTGGGGTCG | 736 |
| | Exon 4 SA (pos 5) | CAGACTGAGAGTGGGGAGAG | 737 |
| | Exon 4 STOP 1 (pos 7) | CCTCCTCCAGAGTGTGGTTG | 738 |
| NR4A1 | Exon 1 STOP 1 (pos 8) | AGCCATCCCAGGGAGAGAGC | 739 |
| | Exon 1 STOP 2 (pos 7) | GCCATCCCAGGGAGAGAGCT | 740 |
| | Exon 1 STOP 3 (pos 6) | CCATCCCAGGGAGAGAGCTG | 741 |
| | Exon 1 STOP 4 (pos 5) | CTCACAGGCCACCCACCAGC | 742 |
| | Exon 2 STOP 1 (pos 8) | CCGCTTCCAGAAGTGCCTGG | 743 |
| | Exon 2 STOP 2 (pos 5) | CTTCCAGAAGTGCCTGGCGG | 744 |
| | Exon 3 SA 1 (pos 5) | ACAACTGCAAAGGAATGGGT | 745 |
| | Exon 3 SA 2 (pos 4) | CAACTGCAAAGGAATGGGTA | 746 |
| | Exon 4 SA (pos 4) | GAACTAGGAAGACGGTCCAG | 747 |
| | Exon 4 STOP 1 (pos 8) | GGCTGACCAGGACCTGTTGC | 748 |
| | Exon 4 SD 1 (pos 5) | CTCACCTGTACGCCAGGCGG | 749 |
| | Exon 4 SD 2 (pos 8) | GCTCTCACCTGTACGCCAGG | 750 |
| | Exon 5 SA (pos 8) | CTTAGACCTGGCAGGCAGAT | 751 |
| | Exon 5 STOP 1 (pos 5) | CAATCCAGTCCCCGAAGCCA | 752 |
| | Exon 5 STOP 2 (pos 4) | AATCCAGTCCCCGAAGCCAC | 753 |
| | Exon 5 SD 1 (pos 6) | ACTCACCGGTGATGAGGACA | 754 |
| | Exon 5 SD 2 (pos 5) | CTCACCGGTGATGAGGACAA | 755 |
| | Exon 6 SA (pos 6) | CCGGTCTGCGGGAAGGGTAC | 756 |
| | Exon 6 STOP 1 (pos 8) | TGGGCTGCAGGAGCCGCGGC | 757 |
| NR4A2 | Exon 1 STOP 1 (pos 7) | TTGTACCAAATGCCCCTGTC | 758 |
| | Exon 1 STOP 2 (pos 8) | CGGACAGCAGTCCTCCATTA | 759 |
| | Exon 1 STOP 3 (pos 6) | AGGTGCAGCACAGCCCCATG | 760 |
| | Exon 1 STOP 4 (pos 5) | GGTGCAGCACAGCCCCATGT | 761 |
| | Exon 1 STOP 5 (pos 7) | AGTTGCCAGATGCGCTTCGA | 762 |

TABLE 12A-continued

| Gene | Description | Target sequence | SEQ ID NO: |
|---|---|---|---|
| | Exon 1 STOP 6 (pos 6) | GTTGCCAGATGCGCTTCGAC | 763 |
| | Exon 1 STOP 7 (pos 5) | GTCTCAGCTGCTCGACACGC | 764 |
| | Exon 3 SD (pos 7) | TTCTTACCCTGGAATAGTCC | 765 |
| | Exon 4 SD (pos 5) | ATTACCTGTATGCTAATCGA | 766 |
| | Exon 5 STOP 1 (pos 4) | TTGCAATGCGTTCGTGGCTT | 767 |
| | Exon 5 SD (pos 6) | ACTGACCTGTGACCATAGCC | 768 |
| NR4A3 | Exon 2 SA (pos 4) | TATCTGCAGGGACAGAGAAA | 769 |
| | Exon 2 STOP 1 (pos 8) | TGCGGCGCAGACATACAGCT | 770 |
| | Exon 2 STOP 2 (pos 6) | CCCCGCAGGCGGGGGCGTTA | 771 |
| | Exon 3 STOP 1 (pos 4) | TTTCAGAAGTGTCTCAGTGT | 772 |
| | Exon 5 SD (pos 5) | ATTACCTGATGGAAAGTCTG | 773 |
| | Exon 6 STOP 1 (pos 4) | CTTCAGTGCCTTCGTGGATT | 774 |
| | Exon 7 SA (pos 4) | TTTCTGCAGAGGGATAGAGA | 775 |
| | Exon 7 STOP 1 (pos 8) | AGACCACCAGAGTAAGGGAC | 776 |
| MCJ | Exon 1 STOP (pos 6) | ACTTGCAGCCCTCGGCCAAA | 777 |
| FAS | Exon 1 SD (pos 9) | AGGGCTCACCAGAGGTAGGA | 778 |
| | Exon 3 SA (pos 6) | TTCACCTGCCCAAGGAAAAA | 779 |
| | Exon 4 SA (pos 7) | CTAAGCCTAGAAAATCAGTT | 780 |
| | Exon 5 SA (pos 5) | ACATCTAGAAAAAAAAATAC | 781 |
| | Exon 5 SD (pos 5) | ATTACCTTCCTCTTTGCACT | 782 |
| | Exon 6 SA (pos 5) | GATCCTGTAGGTTGGAACAT | 783 |
| | Exon 6 STOP 1 (pos 4) | AAGCCACCCCAAGTTAGATC | 784 |
| | Exon 6 SD (pos 7) | AACTTACCCCAAACAATTAG | 785 |
| | Exon 7 SD (pos 8) | ATACCTACAGGATTTAAAGT | 786 |
| | Exon 8 SA (pos 8) | GTTTCCTAGAAAGCAAAAAA | 787 |
| | Exon 9 STOP 1 (pos 6) | AAGTTCAACTGCTTCGTAAT | 788 |
| | Exon 9 STOP (pos 5) | AATTCAGACTATCATCCTCA | 789 |
| SELPG/ PSGL1 | Exon1 STOP 1 (pos 6) | GCTTGCAGCTGTGGGACACC | 790 |
| | Exon1 STOP 2 (pos 8) | GACCACTCAACCAGTGCCCA | 791 |
| | Exon1 STOP 3 (pos 8) | GGAGGCACAGACCACTCCAC | 792 |
| | Exon1 STOP 4 (pos 5) | GGCACAGACAACTCGACTGA | 793 |
| | Exon1 STOP 5 (pos 8) | GGAGGCACAGACCACTCCAC | 794 |
| | Exon1 STOP 6 (pos 4) | GCACAGACCACTCAACCCAC | 795 |
| | Exon1 STOP 7 (pos 8) | GACCACTCAACCCACAGGCC | 796 |
| | Exon1 STOP 8 (pos 8) | GACCACTCAAACCACAGCCA | 797 |
| | Exon1 STOP 9 (pos 8) | GACCACTCAACCCACAGCCA | 798 |
| | Exon1 STOP 10 (pos 8) | GGAGGCACAGACCACTCCAC | 799 |
| | Exon1 STOP 11 (pos 8) | GACCACTCAACCAGCAGCCA | 800 |

TABLE 12B

| Gene | gRNA Name | 5'-Target seq-3' | SEQ ID NO: | Orientation | Target base(s) | Predicted Outcome |
|---|---|---|---|---|---|---|
| PDCD1 | Ex. 1 SD | CACCTACCTAAGAACCATCC | 176 | Antisense | C7 | Splice donor disruption: GT → AT |
| PDCD1 | Ex. 2 SA | GGAGTCTGAGAGATGGAGAG | 381 | Antisense | C6 | Splice acceptor disruption: AG → AA |
| PDCD1 | Ex. 3 SA | TTCTCTCTGGAAGGGCACAA | 393 | Antisense | C7 | Splice acceptor disruption: AG → AA |
| PDCD1 | Ex. 3 SD | GACGTTACCTCGTGCGGCCC | 388 | Antisense | C6 | Splice donor disruption: GT → AT |
| PDCD1 | Ex. 4 SA | CCTGCAGAGAAACACACTTG | 801 | Antisense | C2 | Splice acceptor disruption: AG → AA |
| PDCD1 | Ex. 2 pmSTOP | GGGGTTCCAGGGCCTGTCTG | 177 | Antisense | C7, C8 | pmSTOP induction: TGG (Trp) → TAG, TGA, TAA |
| PDCD1 | Ex. 3 pmSTOP_1 | CAGTTCCAAACCGTGGTGGT | 385 | Sense | C7 | pmSTOP induction: CAA (Gln) → TAA |
| PDCD1 | Ex. 3 pmSTOP_2 | GGACCCAGAGTAGCAGCACC | 387 | Antisense | C5, C6 | pmSTOP induction: TGG (Trp) → TAG, TGA, TAA |

TABLE 12B-continued

| Gene | gRNA Name | 5'-Target seq-3' | SEQ ID NO: | Orientation | Target base(s) | Predicted Outcome |
|---|---|---|---|---|---|---|
| TRAC | Ex. 1 SD | CTTACCTGGGCTGGGGAAGA | 302 | Antisense | C5 | Splice donor disruption: GT → AT |
| TRAC | Ex. 3 SA | TTCGTATCTGTAAAACCAAG | 303 | Antisense | C8 | Splice acceptor disruption: AG → AA |
| TRAC | Ex. 3 pmSTOP_1 | TTTCAAAACCTGTCAGTGAT | 304 | Sense | C4 | pmSTOP induction: CAA (Gln) → TAA |
| TRAC | Ex. 3 pmSTOP_2 | TTCAAAACGTGTGAGTGATT | 305 | Sense | C3 | pmSTOP induction: CAA (Gln) → TAA |
| B2M | Ex. 1 SD | ACTCACGCTGGATAGCCTCC | 499 | Antisense | C6 | Splice donor disruption: GT → AT |
| B2M | Ex. 3 SA | TCGATCTATGAAAAAGACAG | 502 | Antisense | C6 | Splice acceptor disruption: AG → AA |
| B2M | Ex. 2 pmSTOP | CTTACCCCACTTAACTATCT | 506 | Antisense | C7, C8 | pmSTOP induction: TGG (Trp) → TAG, TGA, TAA |

Cas12 Complexes with Guide RNAs

Some aspects of this disclosure provide complexes comprising any of the fusion proteins provided herein, and a guide RNA (e.g., a guide that targets a target polynucleotide for editing).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence. In some embodiments, the 3' end of the target sequence is immediately adjacent to a non-canonical PAM sequence.

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an e.g., TTN, DTTN, GTTN, ATTN, ATTC, DTTNT, WTTN, HATY, TTTN, TTTV, TTTC, TG, RTR, or YTN PAM site.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas12 binding, and a guide sequence, which confers sequence specificity to the Cas12:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas12:nucleic acid editing enzyme/domain fusion proteins to specific genomic target sites will be apparent to those of skill in the art based on the instant disclosure. Such suitable guide RNA sequences typically comprise guide sequences that are complementary to a nucleic acid sequence within 50 nucleotides upstream or downstream of the target nucleotide to be edited. Some exemplary guide RNA sequences suitable for targeting any of the provided fusion proteins to specific target sequences are provided herein.

The domains of the base editor disclosed herein can be arranged in any order as long as the deaminase domain is internalized in the Cas12 protein. Non-limiting examples of a base editor comprising a fusion protein comprising e.g., a Cas12 domain and a deaminase domain can be arranged as following:

NH$_2$-[Cas12 domain]-Linker1-[ABE8]-Linker2-[Cas12 domain]-COOH;

NH$_2$-[Cas12 domain]-Linker1-[ABE8]-[Cas12 domain]-COOH;

NH$_2$-[Cas12 domain]-[ABE8]-Linker2-[Cas12 domain]-COOH;

NH$_2$-[Cas12 domain]-[ABE8]-[Cas12 domain]-COOH;

NH$_2$-[Cas12 domain]-Linker1-[ABE8]-Linker2-[Cas12 domain]-[inosine BER inhibitor]-COOH;

NH$_2$-[Cas12 domain]-Linker1-[ABE8]-[Cas12 domain]-[inosine BER inhibitor]-COOH;

NH$_2$-[Cas12 domain]-[ABE8]-Linker2-[Cas12 domain]-[inosine BER inhibitor]-COOH;

NH$_2$-[Cas12 domain]-[ABE8]-[Cas12 domain]-[inosine BER inhibitor]-COOH;

NH$_2$-[inosine BER inhibitor]-[Cas12 domain]-Linker1-[ABE8]-Linker2-[Cas12 domain]-COOH;

NH$_2$-[inosine BER inhibitor]-[Cas12 domain]-Linker1-[ABE8]-[Cas12 domain]-COOH;

NH$_2$-[inosine BER inhibitor]-[Cas12 domain]-[ABE8]-Linker2-[Cas12 domain]-COOH;

NH$_2$-[inosine BER inhibitor]NH$_2$-[Cas12 domain]-[ABE8]-[Cas12 domain]-COOH;

Additionally, in some cases, a Gam protein can be fused to an N terminus of a base editor. In some cases, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some cases, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitution(s) in any domain does/do not change the length of the base editor. Non-limiting examples of such base editors, where the length of all the domains is the same as the wild type domains, can include:

NH$_2$-[Cas12 domain]-Linker1-[APOBEC1]-Linker2-[Cas12 domain]-COOH;

NH$_2$-[Cas12 domain]-Linker1-[APOBEC1]-[Cas12 domain]-COOH;

NH$_2$-[Cas12 domain]-[APOBEC1]-Linker2-[Cas12 domain]-COOH;

NH$_2$-[Cas12 domain]-[APOBEC1]-[Cas12 domain]-COOH;

NH$_2$-[Cas12 domain]-Linker1-[APOBEC1]-Linker2-[Cas12 domain]-[UGI]-COOH;

NH$_2$-[Cas12 domain]-Linker1-[APOBEC1]-[Cas12 domain]-[UGI]-COOH;

NH$_2$-[Cas12 domain]-[APOBEC1]-Linker2-[Cas12 domain]-[UGI]-COOH;

NH$_2$-[Cas12 domain]-[APOBEC1]-[Cas12 domain]-[UGI]-COOH;

NH$_2$-[UGI]-[Cas12 domain]-Linker1-[APOBEC1]-Linker2-[Cas12 domain]-COOH;

NH$_2$-[UGI]-[Cas12 domain]-Linker1-[APOBEC1]--[Cas12 domain]-COOH;

NH$_2$-[UGI]-[Cas12 domain]-[APOBEC1]-Linker2-[Cas12 domain]-COOH;

NH$_2$-[UGI]-[Cas12 domain]-[APOBEC1]-[Cas12 domain]-COOH;

In some embodiments, the base editing fusion proteins provided herein need to be positioned at a precise location, for example, where a target base is placed within a defined region (e.g., a "deamination window"). In some cases, a target can be within a 4-base region. In some cases, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a napDNAbp domain. In some embodiments, an NLS of the base editor is localized C-terminal to a napDNAbp domain.

Protein domains included in the fusion protein can be a heterologous functional domain. Non-limiting examples of protein domains which can be included in the fusion protein include a deaminase domain (e.g., cytidine deaminase and/or adenosine deaminase), a uracil glycosylase inhibitor (UGI) domain, epitope tags, and reporter gene sequences. Protein domains can be a heterologous functional domain, for example, having one or more of the following activities: transcriptional activation activity, transcriptional repression activity, transcription release factor activity, gene silencing activity, chromatin modifying activity, epigenetic modifying activity, histone modification activity, RNA cleavage activity, and nucleic acid binding activity. Such heterologous functional domains can confer a function activity, such as modification of a target polypeptide associated with target DNA (e.g., a histone, a DNA binding protein, etc.), leading to, for example, histone methylation, histone acetylation, histone ubiquitination, and the like. Other functions and/or activities conferred can include transposase activity, integrase activity, recombinase activity, ligase activity, ubiquitin ligase activity, deubiquitinating activity, adenylation activity, deadenylation activity, SUMOylation activity, deSUMOylation activity, or any combination of the above.

A domain may be detected or labeled with an epitope tag, a reporter protein, other binding domains. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions.

In some embodiments, BhCas12b guide polynucleotide has the following sequence:

```
BhCas12b sgRNA scaffold (underlined) + 20 nt to
23 nt guide sequence (denoted by Nn)
                                 (SEQ ID NO: 802)
5' GUUCUGTCUUUUGGUCAGGACAACCGUCUAGCUAUAAGUGCUGCAGGG

UGUGAGAAACUCCUAUUGCUGGACGAUGUCUCUUACGAGGCAUUAGCACNN

NNNNNNNNNNNNNNNNNNNN-3'
```

In some embodiments, BvCas12b and AaCas12b guide polynucleotides have the following sequences:

```
BvCas12b sgRNA scaffold (underlined) + 20 nt to
23nt guide sequence (denoted by Nn)
                                 (SEQ ID NO: 803)
5' GACCUAUAGGGUCAAUGAAUCUGUGCGUGUGCCAUAAGUAAUUAAAAA

UUACCCACCACAGGAGCACCUGAAAACAGGUGCUUGGCACNNNNNNNNNNNNN

NNNNNNNNNN-3'

AaCas12b sgRNA scaffold (underlined) + 20 nt to
23 nt guide sequence (denoted by Nn)
                                 (SEQ ID NO: 804)
5' GUCUAAAGGACAGAAUUUUUCAACGGGUGUGCCAAUGGCCACUUUCCA

GGUGGCAAAGCCCGUUGAACUUCUCAAAAAGAACGAUCUGAGAAGUGGCAC

NNNNNNNNNNNNNNNNNNNNNNN-3'
```

Methods of Using Fusion Proteins Comprising Adenosine Deaminase Variant and a Cas9 Domain Some aspects of this disclosure provide methods of using the fusion proteins, or complexes provided herein. For example, some aspects of this disclosure provide methods comprising contacting a DNA molecule encoding a mutant form of a protein with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

In some embodiments, a fusion protein of the invention is used for mutagenizing a target of interest. In particular, an adenosine deaminase nucleobase editor (e.g., ABE8) described herein is capable of making multiple mutations within a target sequence. These mutations may affect the function of the target. For example, when an adenosine deaminase nucleobase editor (e.g., ABE8) is used to target a regulatory region the function of the regulatory region is altered and the expression of the downstream protein is reduced.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering.

One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and an adenosine deaminase variant (e.g., ABE8), as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions, HDR is inefficient, dependent on cell state and cell type, and dominated by a larger frequency of indels. As most of the known genetic variations associated with human disease are point mutations, methods that can more efficiently and cleanly make precise point mutations are needed. Base editing systems as provided herein provide a new way to provide genome editing without generating double-strand DNA breaks, without requiring a donor DNA template, and without inducing an excess of stochastic insertions and deletions.

The fusion proteins of the invention advantageously modify a specific nucleotide base encoding a protein comprising a mutation without generating a significant proportion of indels. An "indel," as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In certain embodiments, any of the base editors provided herein are capable of generating a greater proportion of intended modifications
(e.g., mutations) versus indels.

In some embodiments, any of base editor systems pro-
vided herein result in less than 50%, less than 40%, less than
30%, less than 20%, less than 19%, less than 18%, less than
17%, less than 16%, less than 15%, less than 14%, less than
13%, less than 12%, less than 110, less than 10%, less than
9%, less than 8%, less than 7%, less than 6%, less than 5%,
less than 4%, less than 3%, less than 2%, less than 1%, less
than 0.9%, less than 0.8%, less than 0.7%, less than 0.6%,
less than 0.5%, less than 0.4%, less than 0.3%, less than
0.2%, less than 0.1%, less than 0.09%, less than 0.08%, less
than 0.07%, less than 0.06%, less than 0.05%, less than
0.04%, less than 0.03%, less than 0.02%, or less than 0.01%
indel formation in the target polynucleotide sequence.

In some embodiments, any of base editor systems com-
prising one of the ABE8 base editor variants described
herein result in less than 50%, less than 40%, less than 30%,
less than 20%, less than 19%, less than 18%, less than 17%,
less than 16%, less than 15%, less than 14%, less than 13%,
less than 12%, less than 110, less than 10%, less than 9%,
less than 8%, less than 7%, less than 6%, less than 5%, less
than 4%, less than 3%, less than 2%, less than 1%, less than
0.9%, less than 0.8%, less than 0.7%, less than 0.6%, less
than 0.5%, less than 0.4%, less than 0.3%, less than 0.2%,
less than 0.1%, less than 0.09%, less than 0.08%, less than
0.07%, less than 0.06%, less than 0.05%, less than 0.04%,
less than 0.03%, less than 0.02%, or less than 0.01% indel
formation in the target polynucleotide sequence. In some
embodiments, any of base editor systems comprising one of
the ABE8 base editor variants described herein result in less
than 0.8% indel formation in the target polynucleotide
sequence. In some embodiments, any of base editor systems
comprising one of the ABE8 base editor variants described
herein result in at most 0.8% indel formation in the target
polynucleotide sequence. In some embodiments, any of base
editor systems comprising one of the ABE8 base editor
variants described herein result in less than 0.3% indel
formation in the target polynucleotide sequence. In some
embodiments, any of base editor systems comprising one of
the ABE8 base editor variants described results in lower
indel formation in the target polynucleotide sequence com-
pared to a base editor system comprising one of ABE7 base
editors. In some embodiments, any of base editor systems
comprising one of the ABE8 base editor variants described
herein results in lower indel formation in the target poly-
nucleotide sequence compared to a base editor system
comprising an ABE7.10.

In some embodiments, any of base editor systems com-
prising one of the ABE8 base editor variants described
herein has reduction in indel frequency compared to a base
editor system comprising one of the ABE7 base editors. In
some embodiments, any of base editor systems comprising
one of the ABE8 base editor variants described herein has at
least 0.01%, at least 1%, at least 2%, at least 3%, at least 4%,
at least 5%, at least 10%, at least 15%, at least 20%, at least
25%, at least 30%, at least 35%, at least 40%, at least 45%,
at least 50%, at least 55%, at least 60%, at least 65%, at least
70%, at least 75%, at least 80%, at least 85%, at least 90%,
or at least 95% reduction in indel frequency compared to a
base editor system comprising one of the ABE7 base editors.
In some embodiments, a base editor system comprising one
of the ABE8 base editor variants described herein has at least
0.01%, at least 1%, at least 2%, at least 3%, at least 4%, at
least 5%, at least 10%, at least 15%, at least 20%, at least
25%, at least 30%, at least 35%, at least 40%, at least 45%,
at least 50%, at least 55%, at least 60%, at least 65%, at least 70%, at least 75%, at least 80%, at least 85%, at least 90%,
or at least 95% reduction in indel frequency compared to a
base editor system comprising an ABE7.10.

The invention provides adenosine deaminase variants
(e.g., ABE8 variants) that have increased efficiency and
specificity. In particular, the adenosine deaminase variants
described herein are more likely to edit a desired base within
a polynucleotide, and are less likely to edit bases that are not
intended to be altered (e.g., "bystanders").

In some embodiments, any of the base editing system
comprising one of the ABE8 base editor variants described
herein has reduced bystander editing or mutations. In some
embodiments, an unintended editing or mutation is a
bystander mutation or bystander editing, for example, base
editing of a target base (e.g., A or C) in an unintended or
non-target position in a target window of a target nucleotide
sequence. In some embodiments, any of the base editing
system comprising one of the ABE8 base editor variants
described herein has reduced bystander editing or mutations
compared to a base editor system comprising an ABE7 base
editor, e.g., ABE7.10. In some embodiments, any of the base
editing system comprising one of the ABE8 base editor
variants described herein has reduced bystander editing or
mutations by at least 1%, at least 2%, at least 3%, at least
4%, at least 5%, at least 10%, at least 15%, at least 20%, at
least 25%, at least 30%, at least 35%, at least 40%, at least
45%, at least 50%, at least 55%, at least 60%, at least 65%,
at least 70%, at least 75%, at least 80%, at least 85%, at least
90%, at least 95%, or at least 99% compared to a base editor
system comprising an ABE7 base editor, e.g., ABE7.10. In
some embodiments, any of the base editing system com-
prising one of the ABE8 base editor variants described
herein has reduced bystander editing or mutations by at least
1.1 fold, at least 1.2 fold, at least 1.3 fold, at least 1.4 fold,
at least 1.5 fold, at least 1.6 fold, at least 1.7 fold, at least 1.8
fold, at least 1.9 fold, at least 2.0 fold, at least 2.1 fold, at
least 2.2 fold, at least 2.3 fold, at least 2.4 fold, at least 2.5
fold, at least 2.6 fold, at least 2.7 fold, at least 2.8 fold, at
least 2.9 fold, or at least 3.0 fold compared to a base editor
system comprising an ABE7 base editor, e.g., ABE7.10.

In some embodiments, any of the base editing system
comprising one of the ABE8 base editor variants described
herein has reduced spurious editing. In some embodiments,
an unintended editing or mutation is a spurious mutation or
spurious editing, for example, non-specific editing or guide
independent editing of a target base (e.g., A or C) in an
unintended or non-target region of the genome. In some
embodiments, any of the base editing system comprising
one of the ABE8 base editor variants described herein has
reduced spurious editing compared to a base editor system
comprising an ABE7 base editor, e.g., ABE7.10. In some
embodiments, any of the base editing system comprising
one of the ABE8 base editor variants described herein has
reduced spurious editing by at least 1%, at least 2%, at least
3%, at least 4%, at least 5%, at least 10%, at least 15%, at
least 20%, at least 25%, at least 30%, at least 35%, at least
40%, at least 45%, at least 50%, at least 55%, at least 60%,
at least 65%, at least 70%, at least 75%, at least 80%, at least
85%, at least 90%, at least 95%, or at least 99% compared
to a base editor system comprising an ABE7 base editor,
e.g., ABE7.10. In some embodiments, any of the base
editing system comprising one of the ABE8 base editor
variants described herein has reduced spurious editing by at
least 1.1 fold, at least 1.2 fold, at least 1.3 fold, at least 1.4
fold, at least 1.5 fold, at least 1.6 fold, at least 1.7 fold, at
least 1.8 fold, at least 1.9 fold, at least 2.0 fold, at least 2.1
fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations, such as unintended point mutations (i.e., mutation of bystanders). In some embodiments, any of the base editors provided herein are capable of generating at least 0.01% of intended mutations (i.e., at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% base editing efficiency. In some embodiments, the base editing efficiency may be measured by calculating the percentage of edited nucleobases in a population of cells. In some embodiments, any of the ABE8 base editor variants described herein have base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases in a population of cells.

In some embodiments, any of the ABE8 base editor variants described herein has higher base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher base editing efficiency compared to an ABE7 base editor, e.g., ABE7.10.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% on-target base editing efficiency. In some embodiments, any of the ABE8 base editor variants described herein have on-target base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited target nucleobases in a population of cells.

In some embodiments, any of the ABE8 base editor variants described herein has higher on-target base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher on-target base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target base editing efficiency compared to an ABE7 base editor, e.g., ABE7.10.

The ABE8 base editor variants described herein may be delivered to a host cell via a plasmid, a vector, a LNP complex, or an mRNA. In some embodiments, any of the ABE8 base editor variants described herein is delivered to a host cell as an mRNA. In some embodiments, an ABE8 base editor delivered via a nucleic acid based delivery system, e.g., an mRNA, has on-target editing efficiency of at least at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases. In some embodiments, an ABE8 base editor delivered by an mRNA system has higher base editing efficiency compared to an ABE8 base editor delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% on-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target editing efficiency when delivered by an mRNA system compared to when delivered by a plasmid or vector system.

In some embodiments, any of base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% off-target editing in the target polynucleotide sequence.

In some embodiments, any of the ABE8 base editor variants described herein has lower guided off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guided off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold lower guided off-target editing efficiency when delivered by an mRNA system compared to when delivered by a plasmid or vector system. In some embodiments, any of the ABE8 base editor variants described herein has at least about 2.2 fold decrease in guided off-target editing efficiency when delivered by an mRNA system compared to when delivered by a plasmid or vector system.

In some embodiments, any of the ABE8 base editor variants described herein has lower guide-independent off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guide-independent off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 5.0 fold, at least 10.0 fold, at least 20.0 fold, at least 50.0 fold, at least 70.0 fold, at least 100.0 fold, at least 120.0 fold, at least 130.0 fold, or at least 150.0 fold lower guide-independent off-target editing efficiency when delivered by an mRNA system compared to when delivered by a plasmid or vector system. In some embodiments, ABE8 base editor variants described herein has 134.0 fold decrease in guide-independent off-target editing efficiency (e.g., spurious RNA deamination) when delivered by an mRNA system compared to when delivered by a plasmid or vector system. In some embodiments, ABE8 base editor variants described herein does not increase guide-independent mutation rates across the genome.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations (e.g., spurious off-target editing or bystander editing). In some embodiments, an intended mutation is a mutation that is generated by a specific base editor bound to a gRNA, specifically designed to alter or correct a mutation in a target gene. Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to alter or correct an intended mutation. In some embodiments, the intended mutation is a mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor).

In some embodiments, the base editors provided herein are capable of generating a ratio of intended mutations to indels (i.e., unintended mutations) that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. It should be appreciated that the characteristics of the base editors described herein may be applied to any of the fusion proteins, or methods of using the fusion proteins provided herein.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, any number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor system with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that requires a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editor provided herein. It should also be appreciated that the multiplex editing using any of the base editors as described herein can comprise a sequential editing of a plurality of nucleobase pairs.

In some embodiments, the plurality of nucleobase pairs are in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region. In some embodiments, the editing is editing of the plurality of nucleobase pairs in at least one protein non-coding region. In some embodiments, the editing is editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

In some embodiments, the base editor system capable of multiplex editing of a plurality of nucleobase pairs in one or more genes comprises one of the ABE8 base editor variants described herein. In some embodiments, the base editor system capable of multiplex editing of a plurality of nucleobase pairs in one or more genes comprises one of ABE7 base editors. In some embodiments, the base editor system capable of multiplex editing comprising one of the ABE8 base editor variants described herein has higher multiplex editing efficiency compared the base editor system capable of multiplex editing comprising one of ABE7 base editors. In some embodiments, the base editor system capable of multiplex editing comprising one of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% higher multiplex editing efficiency compared the base editor system capable of multiplex editing comprising one of ABE7 base editors. In some embodiments, the base editor system capable of multiplex editing comprising one of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 4.0 fold, at least 4.5 fold, at least 5.0 fold, at least 5.5 fold, or at least 6.0 fold higher multiplex editing efficiency compared the base editor system capable of multiplex editing comprising one of ABE7 base editors.

Fusion Proteins with Internal Insertions

Provided herein are fusion proteins comprising a heterologous polypeptide fused to a nucleic acid programmable nucleic acid binding protein, for example, a napDNAbp. A heterologous polypeptide can be a polypeptide that is not found in the native or wild-type napDNAbp polypeptide sequence. The heterologous polypeptide can be fused to the napDNAbp at a C-terminal end of the napDNAbp, an N-terminal end of the napDNAbp, or inserted at an internal location of the napDNAbp. In some embodiments, the heterologous polypeptide is inserted at an internal location of the napDNAbp.

In some embodiments, the heterologous polypeptide is a deaminase or a functional fragment thereof. For example, a fusion protein can comprise a deaminase (e.g., adenosine deaminase) flanked by an N- terminal fragment and a C-terminal fragment of a Cas9 or Cas12 (e.g., Cas12b/C2cl), polypeptide. The deaminase in a fusion protein can be an adenosine deaminase. In some embodiments, the adenosine deaminase is a TadA (e.g., TadA7.10 or TadA*8). In some embodiments, the TadA is a TadA*8. TadA sequences (e.g. TadA7.10 or TadA*8) as described herein are suitable deaminases for the above-described fusion proteins.

The deaminase can be a circular permutant deaminase. For example, the deaminase can be a circular permutant adenosine deaminase. In some embodiments, the deaminase is a circular permutant TadA, circularly permutated at amino acid residue 116 as numbered in the TadA reference sequence. In some embodiments, the deaminase is a circular permutant TadA, circularly permutated at amino acid residue 136 as numbered in the TadA reference sequence. In some embodiments, the deaminase is a circular permutant TadA, circularly permutated at amino acid residue 65 as numbered in the TadA reference sequence.

The fusion protein can comprise more than one deaminase. The fusion protein can comprise, for example, 1, 2, 3, 4, 5 or more deaminases. In some embodiments, the fusion protein comprises one deaminase. In some embodiments, the fusion protein comprises two deaminases. The two or more deaminases can be homodimers. The two or more deaminases can be heterodimers. The two or more deaminases can be inserted in tandem in the napDNAbp. In some embodiments, the two or more deaminases may not be in tandem in the napDNAbp.

In some embodiments, the napDNAbp in the fusion protein is a Cas9 polypeptide or a fragment thereof. The Cas9 polypeptide can be a variant Cas9 polypeptide. In some embodiments, the Cas9 polypeptide is a Cas9 nickase (nCas9) polypeptide or a fragment thereof. In some embodiments, the Cas9 polypeptide is a nuclease dead Cas9 (dCas9)

polypeptide or a fragment thereof. The Cas9 polypeptide in a fusion protein can be a full-length Cas9 polypeptide. In some cases, the Cas9 polypeptide in a fusion protein may not be a full length Cas9 polypeptide. The Cas9 polypeptide can be truncated, for example, at a N-terminal or C-terminal end relative to a naturally-occurring Cas9 protein. The Cas9 polypeptide can be a circularly permuted Cas9 protein. The Cas9 polypeptide can be a fragment, a portion, or a domain of a Cas9 polypeptide, that is still capable of binding the target polynucleotide and a guide nucleic acid sequence.

In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or fragments or variants thereof.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas9 polypeptide.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to the Cas9 amino acid sequence set forth below (called the "Cas9 reference sequence" below):

In some embodiments, the napDNAbp in the fusion protein is a Cas12 polypeptide, e.g., Cas12b/C2c1, or a fragment thereof. The Cas12 polypeptide can be a variant Cas12 polypeptide.

The heterologous polypeptide (e.g., deaminase) can be inserted in the napDNAbp (e.g., Cas9 or Cas12 (e.g., Cas12b/C2cl)) at a suitable location, for example, such that the napDNAbp retains its ability to bind the target polynucleotide and a guide nucleic acid. A deaminase (e.g., adenosine deaminase) can be inserted into a napDNAbp without compromising function of the deaminase (e.g., base editing activity) or the napDNAbp (e.g. ability to bind to target nucleic acid and guide nucleic acid). A deaminase (e.g., adenosine deaminase) can be inserted in the napDNAbp at, for example, a disordered region or a region comprising a high temperature factor or B-factor as shown by crystallographic studies. Regions of a protein that are less ordered, disordered, or unstructured, for example solvent exposed regions and loops, can be used for insertion without compromising structure or function. A deaminase (e.g., adenosine deaminase) can be inserted in the napDNAbp in a flexible loop region or a solvent-exposed region. In some embodiments, the deaminase (e.g. adenosine deaminase) is inserted in a flexible loop of the Cas9 or the Cas12b/C2cl polypeptide.

(SEQ ID NO: 8)

MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQG<u>DSLHEHIANLAGSPAIKKGILQTVKVV</u>

<u>DELVKVMGRHKPENIVIEMAR</u>ENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERG<u>GLSELDKAGFIKRQLVETRQITKH</u>

<u>VAQILDSRMNTKYDENDKLIREVKVITLKSKLVSDFRKDFQFYKVREINNYHHAHDAYLNAV</u>

<u>VGTALIKKYPKLESEFVYGDYKVYDVRKMIAKSEQEIGKATAKYFFYSNIMNFFKTEITLAN</u>

<u>GEIRKRPLIETNGETGEIVWDKGRDFATVRKVLSMPQVNIVKKTEVQ</u>TGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
(single underline: HNH domain; double underline: RuvC domain)

In some embodiments, the insertion location of a deaminase (e.g., adenosine deaminase) is determined by B-factor analysis of the crystal structure of Cas9 polypeptide. In some embodiments, the deaminase (e.g., adenosine deaminase) is inserted in regions of the Cas9 polypeptide comprising higher than average B-factors (e.g., higher B factors compared to the total protein or the protein domain comprising the disordered region). B-factor or temperature factor can indicate the fluctuation of atoms from their average position (for example, as a result of temperature-dependent atomic vibrations or static disorder in a crystal lattice). A high B-factor (e.g., higher than average B-factor) for backbone atoms can be indicative of a region with relatively high local mobility. Such a region can be used for inserting a deaminase without compromising structure or function. A deaminase (e.g. adenosine deaminase) can be inserted at a location with a residue having a Ca atom with a B-factor that is 50%, 60%, 70%, 80%, 90%, 100%, 110%, 120%, 130%, 140%, 150%, 160%, 170%, 180%, 190%, 200%, or greater than 200% more than the average B-factor for the total protein. A deaminase (e.g., adenosine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%, 200% or greater than 200% more than the average B-factor for a Cas9 protein domain comprising the residue. Cas9 polypeptide positions comprising a higher than average B-factor can include, for example, residues 768, 792, 1052, 1015, 1022, 1026, 1029, 1067, 1040, 1054, 1068, 1246, 1247, and 1248 as numbered in the above Cas9 reference sequence. Cas9 polypeptide regions comprising a higher than average B-factor can include, for example, residues 792-872, 792-906, and 2-791 as numbered in the above Cas9 reference sequence.

A heterologous polypeptide (e.g., deaminase) can be inserted in the napDNAbp at an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. In some embodiments, the heterologous polypeptide is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the above Cas9 reference sequence or corresponding amino acid positions thereof. In some embodiments, the heterologous polypeptide is inserted between amino acid positions 769-770, 792-793, 793-794, 1016-1017, 1023-1024, 1027-1028, 1030-1031, 1041-1042, 1053-1054, 1055-1056, 1068-1069, 1069-1070, 1248-1249, or 1249-1250 as numbered in the above Cas9 reference sequence or corresponding amino acid positions thereof. In some embodiments, the heterologous polypeptide replaces an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. It should be understood that the reference to the above Cas9 reference sequence with respect to insertion positions is for illustrative purposes. The insertions as discussed herein are not limited to the Cas9 polypeptide sequence of the above Cas9 reference sequence, but include insertion at corresponding locations in variant Cas9 polypeptides, for example a Cas9 nickase (nCas9), nuclease dead Cas9

(dCas9), a Cas9 variant lacking a nuclease domain, a truncated Cas9, or a Cas9 domain lacking partial or complete HNH domain.

A heterologous polypeptide (e.g., deaminase) can be inserted in the napDNAbp at an amino acid residue selected from the group consisting of: 768, 792, 1022, 1026, 1040, 1068, and 1247 as numbered in the above Cas9 reference sequence, or a corresponding amino acid residue in another Cas9 polypeptide. In some embodiments, the heterologous polypeptide is inserted between amino acid positions 768-769, 792-793, 1022-1023, 1026-1027, 1029-1030, 1040-1041, 1068-1069, or 1247-1248 as numbered in the above Cas9 reference sequence or corresponding amino acid positions thereof. In some embodiments, the heterologous polypeptide is inserted between amino acid positions 769-770, 793-794, 1023-1024, 1027-1028, 1030-1031, 1041-1042, 1069-1070, or 1248-1249 as numbered in the above Cas9 reference sequence or corresponding amino acid positions thereof. In some embodiments, the heterologous polypeptide replaces an amino acid residue selected from the group consisting of: 768, 792, 1022, 1026, 1040, 1068, and 1247 as numbered in the above Cas9 reference sequence, or a corresponding amino acid residue in another Cas9 polypeptide.

A heterologous polypeptide (e.g., deaminase) can be inserted in the napDNAbp at an amino acid residue as described herein, or a corresponding amino acid residue in another Cas9 polypeptide. In an embodiment, a heterologous polypeptide (e.g., deaminase) can be inserted in the napDNAbp at an amino acid residue selected from the group consisting of: 1002, 1003, 1025, 1052-1056, 1242-1247, 1061-1077, 943-947, 686-691, 569-578, 530-539, and 1060-1077 as numbered in the above Cas9 reference sequence, or a corresponding amino acid residue in another Cas9 polypeptide. The deaminase (e.g., adenosine deaminase) can be inserted at the N-terminus or the C-terminus of the residue or replace the residue. In some embodiments, the deaminase (e.g., adenosine deaminase) is inserted at the C-terminus of the residue.

In some embodiments, an adenosine deaminase (e.g., TadA) is inserted at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, an adenosine deaminase (e.g., TadA) is inserted in place of residues 792-872, 792-906, or 2-791 as numbered in the above Cas9 reference sequence, or a corresponding amino acid residue in another Cas9 polypeptide. In some embodiments, the adenosine deaminase is inserted at the N-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted at the C-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted to replace an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

In some embodiments, the deaminase (e.g., adenosine deaminase) is inserted at amino acid residue 768 as numbered in the above Cas9 reference sequence, or a corresponding amino acid residue in another Cas9 polypeptide. In some embodiments, the deaminase (e.g., adenosine deaminase) is inserted at the N-terminus of amino acid residue 768 as numbered in the above Cas9 reference sequence, or a corresponding amino acid residue in another Cas9 polypeptide. In some embodiments, the deaminase (e.g., adenosine deaminase) is inserted at the C-terminus of amino acid residue 768 as numbered in the above Cas9 reference sequence, or a corresponding amino acid residue in another Cas9 polypeptide. In some embodiments, the deaminase (e.g., adenosine deaminase) is inserted to replace amino acid residue 768 as numbered in the above Cas9 reference sequence, or a corresponding amino acid residue in another Cas9 polypeptide.

In some embodiments, the deaminase (e.g., adenosine deaminase) is inserted at amino acid residue 791 or is inserted at amino acid residue 792, as numbered in the above Cas9 reference sequence, or a corresponding amino acid residue in another Cas9 polypeptide. In some embodiments, the deaminase (e.g., adenosine deaminase) is inserted at the N-terminus of amino acid residue 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase) is inserted at the C-terminus of amino acid 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase) is inserted to replace amino acid 791, or is inserted to replace amino acid 792, as numbered in the above Cas9 reference sequence, or a corresponding amino acid residue in another Cas9 polypeptide.

In some embodiments, the deaminase (e.g., adenosine deaminase) is inserted at amino acid residue 1016 as numbered in the above Cas9 reference sequence, or a corresponding amino acid residue in another Cas9 polypeptide. In some embodiments, the deaminase (e.g., adenosine deaminase) is inserted at the N-terminus of amino acid residue 1016 as numbered in the above Cas9 reference sequence, or a corresponding amino acid residue in another Cas9 polypeptide. In some embodiments, the deaminase (e.g., adenosine deaminase) is inserted at the C-terminus of amino acid residue 1016 as numbered in the above Cas9 reference sequence, or a corresponding amino acid residue in another Cas9 polypeptide. In some embodiments, the deaminase (e.g., adenosine deaminase) is inserted to replace amino acid residue 1016 as numbered in the above Cas9 reference sequence, or a corresponding amino acid residue in another Cas9 polypeptide.

In some embodiments, the deaminase (e.g., adenosine deaminase) is inserted at amino acid residue 1022, or is inserted at amino acid residue 1023, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1022 or is inserted at the N-terminus of amino acid residue 1023, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1022 or is inserted at the C-terminus of amino acid residue 1023, as numbered in the above Cas9 reference sequence, or a corresponding amino acid residue in another Cas9 polypeptide. In some embodiments, the deaminase (e.g., adenosine deaminase) is inserted to replace amino acid residue 1022, or is inserted to replace amino acid residue 1023, as numbered in the above Cas9 reference sequence, or a corresponding amino acid residue in another Cas9 polypeptide.

In some embodiments, the deaminase (e.g., adenosine deaminase) is inserted at amino acid residue 1026, or is inserted at amino acid residue 1029, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1026 or is inserted at the N-terminus of amino acid residue 1029, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1026 or is inserted at the C-terminus of amino acid residue 1029, as numbered in the above Cas9 reference sequence, or a corresponding amino acid residue in another Cas9 polypeptide. In some embodiments, the deaminase (e.g., adenosine deaminase) is inserted to replace amino acid residue 1026, or is inserted to replace amino acid residue 1029, as numbered in the above Cas9 reference sequence, or corresponding amino acid residue in another Cas9 polypeptide.

In some embodiments, the deaminase (e.g., adenosine deaminase) is inserted at amino acid residue 1040 as numbered in the above Cas9 reference sequence, or a corresponding amino acid residue in another Cas9 polypeptide. In some embodiments, the deaminase (e.g., adenosine deaminase) is inserted at the N-terminus of amino acid residue 1040 as numbered in the above Cas9 reference sequence, or a corresponding amino acid residue in another Cas9 polypeptide. In some embodiments, the deaminase (e.g., adenosine deaminase) is inserted at the C-terminus of amino acid residue 1040 as numbered in the above Cas9 reference sequence, or a corresponding amino acid residue in another Cas9 polypeptide. In some embodiments, the deaminase (e.g., adenosine deaminase) is inserted to replace amino acid residue 1040 as numbered in the above Cas9 reference sequence, or a corresponding amino acid residue in another Cas9 polypeptide.

In some embodiments, the deaminase (e.g., adenosine deaminase) is inserted at amino acid residue 1052, or is inserted at amino acid residue 1054, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1052 or is inserted at the N-terminus of amino acid residue 1054, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1052 or is inserted at the C-terminus of amino acid residue 1054, as numbered in the above Cas9 reference sequence, or a corresponding amino acid residue in another Cas9 polypeptide. In some embodiments, the deaminase (e.g., adenosine deaminase) is inserted to replace amino acid residue 1052, or is inserted to replace amino acid residue 1054, as numbered in the above Cas9 reference sequence, or a corresponding amino acid residue in another Cas9 polypeptide.

In some embodiments, the deaminase (e.g., adenosine deaminase) is inserted at amino acid residue 1067, or is inserted at amino acid residue 1068, or is inserted at amino acid residue 1069, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1067 or is inserted at the N-terminus of amino acid residue 1068 or is inserted at the N-terminus of amino acid residue 1069, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1067 or is inserted at the C-terminus of amino acid residue 1068 or is inserted at the C-terminus of amino acid residue 1069, as numbered in the above Cas9 reference sequence, or a corresponding amino acid residue in another Cas9 polypeptide. In some embodiments, the deaminase (e.g., adenosine deaminase) is inserted to replace amino acid residue 1067, or is inserted to replace amino acid residue 1068, or is inserted to replace amino acid residue 1069, as numbered in the above Cas9 reference sequence, or a corresponding amino acid residue in another Cas9 polypeptide.

In some embodiments, the deaminase (e.g., adenosine deaminase) is inserted at amino acid residue 1246, or is inserted at amino acid residue 1247, or is inserted at amino acid residue 1248, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1246 or is inserted at the N-terminus of amino acid residue 1247 or is inserted at the N-terminus of amino acid residue 1248, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1246 or is inserted at the C-terminus of amino acid residue 1247 or is inserted at the C-terminus of amino acid residue 1248, as numbered in the above Cas9 reference sequence, or a corresponding amino acid residue in another Cas9 polypeptide. In some embodiments, the deaminase (e.g., adenosine deaminase) is inserted to replace amino acid residue 1246, or is inserted to replace amino acid residue 1247, or is inserted to replace amino acid residue 1248, as numbered in the above Cas9 reference sequence, or a corresponding amino acid residue in another Cas9 polypeptide.

In some embodiments, a heterologous polypeptide (e.g., deaminase) is inserted in a flexible loop of a Cas9 polypeptide. The flexible loop portions can be selected from the group consisting of 530-537, 569-570, 686-691, 943-947, 1002-1025, 1052-1077, 1232-1247, or 1298-1300 as numbered in the above Cas9 reference sequence, or a corresponding amino acid residue in another Cas9 polypeptide. The flexible loop portions can be selected from the group consisting of: 1-529, 538-568, 580-685, 692-942, 948-1001, 1026-1051, 1078-1231, or 1248-1297 as numbered in the above Cas9 reference sequence, or a corresponding amino acid residue in another Cas9 polypeptide.

A heterologous polypeptide (e.g., adenine deaminase) can be inserted into a Cas9 polypeptide region corresponding to amino acid residues: 1017-1069, 1242-1247, 1052-1056, 1060-1077, 1002-1003, 943-947, 530-537, 568-579, 686-691,1242-1247, 1298-1300, 1066-1077, 1052-1056, or 1060-1077 as numbered in the above Cas9 reference sequence, or a corresponding amino acid residue in another Cas9 polypeptide.

A heterologous polypeptide (e.g., adenine deaminase) can be inserted in place of a deleted region of a Cas9 polypeptide. The deleted region can correspond to an N-terminal or C-terminal portion of the Cas9 polypeptide. In some embodiments, the deleted region corresponds to residues 792-872 as numbered in the above Cas9 reference sequence, or a corresponding amino acid residue in another Cas9 polypeptide. In some embodiments, the deleted region corresponds to residues 792-906 as numbered in the above Cas9 reference sequence, or a corresponding amino acid residue in another Cas9 polypeptide. In some embodiments, the deleted region corresponds to residues 2-791 as numbered in the above Cas9 reference sequence, or a corresponding amino acid residue in another Cas9 polypeptide. In some embodiments, the deleted region corresponds to residues 1017-1069 as numbered in the above Cas9 reference sequence, or corresponding amino acid residues thereof.

Exemplary internal fusions base editors are provided in Table 13A below:

TABLE 13A

Insertion loci in Cas9 proteins

| BE ID | Modification | Other ID |
|---|---|---|
| IBE001 | Cas9 TadA ins 1015 | ISLAY01 |
| IBE002 | Cas9 TadA ins 1022 | ISLAY02 |
| IBE003 | Cas9 TadA ins 1029 | ISLAY03 |
| IBE004 | Cas9 TadA ins 1040 | ISLAY04 |
| IBE005 | Cas9 TadA ins 1068 | ISLAY05 |
| IBE006 | Cas9 TadA ins 1247 | ISLAY06 |
| IBE007 | Cas9 TadA ins 1054 | ISLAY07 |
| IBE008 | Cas9 TadA ins 1026 | ISLAY08 |
| IBE009 | Cas9 TadA ins 768 | ISLAY09 |
| IBE020 | delta HNH TadA 792 | ISLAY20 |
| IBE021 | N-term fusion single TadA helix truncated 165-end | ISLAY21 |
| IBE029 | TadA-Circular Permutant116 ins1067 | ISLAY29 |
| IBE031 | TadA-Circular Permutant 136 ins1248 | ISLAY31 |
| IBE032 | TadA-Circular Permutant 136 ins 1052 | ISLAY32 |
| IBE035 | delta 792-872 TadA ins | ISLAY35 |
| IBE036 | delta 792-906 TadA ins | ISLAY36 |
| IBE043 | TadA-Circular Permutant 65 ins1246 | ISLAY43 |
| IBE044 | TadA ins C-term truncate2 791 | ISLAY44 |

A heterologous polypeptide (e.g., deaminase) can be inserted within a structural or functional domain of a Cas9 polypeptide. A heterologous polypeptide (e.g., deaminase) can be inserted between two structural or functional domains of a Cas9 polypeptide. A heterologous polypeptide (e.g., deaminase) can be inserted in place of a structural or functional domain of a Cas9 polypeptide, for example, after deleting the domain from the Cas9 polypeptide. The structural or functional domains of a Cas9 polypeptide can include, for example, RuvC I, RuvC II, RuvC III, Rec1, Rec2, PI, or HNH.

In some embodiments, the Cas9 polypeptide lacks one or more domains selected from the group consisting of. RuvC I, RuvC II, RuvC III, Rec1, Rec2, PI, or HNH domain. In some embodiments, the Cas9 polypeptide lacks a nuclease domain. In some embodiments, the Cas9 polypeptide lacks an HNH domain. In some embodiments, the Cas9 polypeptide lacks a portion of the HNH domain such that the Cas9 polypeptide has reduced or abolished HNH activity.

In some embodiments, the Cas9 polypeptide comprises a deletion of the nuclease domain, and the deaminase is inserted to replace the nuclease domain. In some embodiments, the HNH domain is deleted and the deaminase is inserted in its place. In some embodiments, one or more of the RuvC domains is deleted and the deaminase is inserted in its place.

A fusion protein comprising a heterologous polypeptide can be flanked by a N-terminal and a C-terminal fragment of a napDNAbp. In some embodiments, the fusion protein comprises a deaminase flanked by a N- terminal fragment and a C-terminal fragment of a Cas9 polypeptide. The N terminal fragment or the C terminal fragment can bind the target polynucleotide sequence. The C-terminus of the N terminal fragment or the N-terminus of the C terminal fragment can comprise a part of a flexible loop of a Cas9 polypeptide. The C-terminus of the N terminal fragment or the N-terminus of the C terminal fragment can comprise a part of an alpha-helix structure of the Cas9 polypeptide. The N-terminal fragment or the C-terminal fragment can comprise a DNA binding domain. The N-terminal fragment or the C-terminal fragment can comprise a RuvC domain. The N-terminal fragment or the C-terminal fragment can comprise an HNH domain. In some embodiments, neither of the N-terminal fragment and the C-terminal fragment comprises an HNH domain.

In some embodiments, the C-terminus of the N terminal Cas9 fragment comprises an amino acid that is in proximity to a target nucleobase when the fusion protein deaminates the target nucleobase. In some embodiments, the N-terminus of the C terminal Cas9 fragment comprises an amino acid that is in proximity to a target nucleobase when the fusion protein deaminates the target nucleobase. The insertion location of different deaminases can be different in order to have proximity between the target nucleobase and an amino acid in the C-terminus of the N terminal Cas9 fragment or the N-terminus of the C terminal Cas9 fragment. For example, the insertion position of an ABE can be at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

The N-terminal Cas9 fragment of a fusion protein (i.e. the N-terminal Cas9 fragment flanking the deaminase in a fusion protein) can comprise the N-terminus of a Cas9 polypeptide. The N-terminal Cas9 fragment of a fusion protein can comprise a length of at least about: 100, 200, 300, 400, 500, 600, 700, 800, 900, 1000, 1100, 1200, or 1300 amino acids. The N-terminal Cas9 fragment of a fusion protein can comprise a sequence corresponding to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide.

The C-terminal Cas9 fragment of a fusion protein (i.e. the C-terminal Cas9 fragment flanking the deaminase in a fusion protein) can comprise the C-terminus of a Cas9 polypeptide. The C-terminal Cas9 fragment of a fusion protein can comprise a length of at least about: 100, 200, 300, 400, 500, 600, 700, 800, 900, 1000, 1100, 1200, or 1300 amino acids. The C-terminal Cas9 fragment of a fusion protein can comprise a sequence corresponding to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide.

The N-terminal Cas9 fragment and C-terminal Cas9 fragment of a fusion protein taken together may not correspond to a full-length naturally occurring Cas9 polypeptide sequence, for example, as set forth in the above Cas9 reference sequence.

The fusion protein described herein can effect targeted deamination with reduced deamination at non-target sites (e.g., off-target sites), such as reduced genome wide spurious deamination. The fusion protein described herein can effect targeted deamination with reduced bystander deamination at non-target sites. The undesired deamination or off-target deamination can be reduced by at least 30%, at least 40%, at least 50%, at least 60%, at least 70%, at least 80%, at least 90%, at least 95%, or at least 99% compared with, for example, an end terminus fusion protein comprising the deaminase fused to a N terminus or a C terminus of a Cas9 polypeptide. The undesired deamination or off-target deamination can be reduced by at least one-fold, at least two-fold, at least three-fold, at least four-fold, at least five-fold, at least tenfold, at least fifteen fold, at least twenty fold, at least thirty fold, at least forty fold, at least fifty fold, at least 60 fold, at least 70 fold, at least 80 fold, at least 90 fold, or at least hundred fold, compared with, for example, an end terminus fusion protein comprising the deaminase fused to a N terminus or a C terminus of a Cas9 polypeptide.

In some embodiments, the deaminase (e.g., adenosine deaminase) of the fusion protein deaminates no more than two nucleobases within the range of an R-loop. In some embodiments, the deaminase of the fusion protein deaminates no more than three nucleobases within the range of the R-loop. In some embodiments, the deaminase of the fusion protein deaminates no more than 2, 3, 4, 5, 6, 7, 8, 9, or 10 nucleobases within the range of the R-loop. An R-loop is a three-stranded nucleic acid structure including a DNA:RNA hybrid, a DNA:DNA or an RNA:RNA complementary structure and the associated with single-stranded DNA. As used herein, an R-loop may be formed when a target polynucleotide is contacted with a CRISPR complex or a base editing complex, wherein a portion of a guide polynucleotide, e.g. a guide RNA, hybridizes with and displaces with a portion of a target polynucleotide, e.g. a target DNA. In some embodiments, an R-loop comprises a hybridized region of a spacer sequence and a target DNA complementary sequence. An R-loop region may be of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleobase pairs in length. In some embodiments, the R-loop region is about 20 nucleobase pairs in length. It should be understood that, as used herein, an R-loop region is not limited to the target DNA strand that hybridizes with the guide polynucleotide. For example, editing of a target nucleobase within an R-loop region may be to a DNA strand that comprises the complementary strand to a guide RNA, or may be to a DNA strand that is the opposing strand of the strand complementary to the guide RNA. In some embodiments, editing in the region of the R-loop comprises editing a nucleobase on non-complementary strand (protospacer strand) to a guide RNA in a target DNA sequence.

The fusion protein described herein can effect target deamination in an editing window different from canonical base editing. In some embodiments, a target nucleobase is from about 1 to about 20 bases upstream of a PAM sequence in the target polynucleotide sequence. In some embodiments, a target nucleobase is from about 2 to about 12 bases upstream of a PAM sequence in the target polynucleotide sequence. In some embodiments, a target nucleobase is from about 1 to 9 base pairs, about 2 to 10 base pairs, about 3 to 11 base pairs, about 4 to 12 base pairs, about 5 to 13 base pairs, about 6 to 14 base pairs, about 7 to 15 base pairs, about 8 to 16 base pairs, about 9 to 17 base pairs, about 10 to 18 base pairs, about 11 to 19 base pairs, about 12 to 20 base pairs, about 1 to 7 base pairs, about 2 to 8 base pairs, about 3 to 9 base pairs, about 4 to 10 base pairs, about 5 to 11 base pairs, about 6 to 12 base pairs, about 7 to 13 base pairs, about 8 to 14 base pairs, about 9 to 15 base pairs, about 10 to 16 base pairs, about 11 to 17 base pairs, about 12 to 18 base pairs, about 13 to 19 base pairs, about 14 to 20 base pairs, about 1 to 5 base pairs, about 2 to 6 base pairs, about 3 to 7 base pairs, about 4 to 8 base pairs, about 5 to 9 base pairs, about 6 to 10 base pairs, about 7 to 11 base pairs, about 8 to 12 base pairs, about 9 to 13 base pairs, about 10 to 14 base pairs, about 11 to 15 base pairs, about 12 to 16 base pairs, about 13 to 17 base pairs, about 14 to 18 base pairs, about 15 to 19 base pairs, about 16 to 20 base pairs, about 1 to 3 base pairs, about 2 to 4 base pairs, about 3 to 5 base pairs, about 4 to 6 base pairs, about 5 to 7 base pairs, about 6 to 8 base pairs, about 7 to 9 base pairs, about 8 to 10 base pairs, about 9 to 11 base pairs, about 10 to 12 base pairs, about 11 to 13 base pairs, about 12 to 14 base pairs, about 13 to 15 base pairs, about 14 to 16 base pairs, about 15 to 17 base pairs, about 16 to 18 base pairs, about 17 to 19 base pairs, about 18 to 20 base pairs away or upstream of the PAM sequence. In some embodiments, a target nucleobase is about 1, 2, 3, 4, 5, 6, 7, 8, 9, 10, 11, 12, 13, 14, 15, 16, 17, 18, 19, 20, or more base pairs away from or upstream of the PAM sequence. In some embodiments, a target nucleobase is about 1, 2, 3, 4, 5, 6, 7, 8, or 9 base pairs upstream of the PAM sequence. In some embodiments, a target nucleobase is about 2, 3, 4, or 6 base pairs upstream of the PAM sequence.

The fusion protein can comprise more than one heterologous polypeptide. For example, the fusion protein can additionally comprise one or more UGI domains and/or one or more nuclear localization signals. The two or more heterologous domains can be inserted in tandem. The two or more heterologous domains can be inserted at locations such that they are not in tandem in the NapDNAbp.

A fusion protein can comprise a linker between the deaminase and the napDNAbp polypeptide. The linker can be a peptide or a non-peptide linker. For example, the linker can be an XTEN, (GGGS)n (SEQ ID NO: 271), (GGGGS)n (SEQ ID NO: 272), (G)n, (EAAAK)n (SEQ ID NO: 273), (GGS)n, SGSETPGTSESATPES (SEQ ID NO: 60). In some embodiments, the fusion protein comprises a linker between the N-terminal Cas9 fragment and the deaminase. In some embodiments, the fusion protein comprises a linker between the C-terminal Cas9 fragment and the deaminase. In some embodiments, the N-terminal and C-terminal fragments of napDNAbp are connected to the deaminase with a linker. In some embodiments, the N-terminal and C-terminal fragments are joined to the deaminase domain without a linker. In some embodiments, the fusion protein comprises a linker between the N-terminal Cas9 fragment and the deaminase, but does not comprise a linker between the C-terminal Cas9 fragment and the deaminase. In some embodiments, the fusion protein comprises a linker between the C-terminal Cas9 fragment and the deaminase, but does not comprise a linker between the N-terminal Cas9 fragment and the deaminase.

In other embodiments, the N- or C-terminal fragments of the Cas12 polypeptide comprise a nucleic acid programmable DNA binding domain or a RuvC domain. In other embodiments, the fusion protein contains a linker between the Cas12 polypeptide and the catalytic domain. In other embodiments, the amino acid sequence of the linker is GGSGGS (SEQ ID NO: 225) or GSSGSETPGTSESAT-PESSG (SEQ ID NO: 805). In other embodiments, the linker is a rigid linker. In other embodiments of the above aspects, the linker is encoded by GGAGGCTCTGGAGGAAGC (SEQ ID NO: 806) or GGCTCTTCTGGATCT-GAAACACCTGGCACAAGCGAGAGCGCCACCCCT-GAGAGCTCTGGC (SEQ ID NO: 807).

Fusion proteins comprising a heterologous catalytic domain flanked by N- and C-terminal fragments of a Cas9 or Cas12 polypeptide are also useful for base editing in the methods as described herein. Fusion proteins comprising Cas9 or Cas12 and one or more deaminase domains, e.g., adenosine deaminase, or comprising an adenosine deaminase domain flanked by Cas9 or Cas12 sequences are also useful for highly specific and efficient base editing of target sequences. In an embodiment, a chimeric Cas9 or Cas12 fusion protein contains a heterologous catalytic domain inserted within a Cas12 polypeptide.

In various embodiments, the catalytic domain has DNA modifying activity (e.g., deaminase activity), such as adenosine deaminase activity. In some embodiments, the adenosine deaminase is a TadA (e.g., TadA7.10). In some embodiments, the TadA is a TadA*8. In other embodiments, the fusion protein contains one or more catalytic domains. In other embodiments, at least one of the one or more catalytic domains is inserted within the Cas12 polypeptide or is fused at the Cas12 N- terminus or C-terminus. In other embodiments, at least one of the one or more catalytic domains is inserted within a loop, an alpha helix region, an unstructured portion, or a solvent accessible portion of the Cas12 polypeptide. In other embodiments, the Cas12 polypeptide is Cas12a, Cas12b, Cas12c, Cas12d, Cas12e, Cas12g, Cas12h, or Cas12i. In other embodiments, the Cas12 polypeptide has at least about 85% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 90% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 95% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide contains or consists essentially of a fragment of *Bacillus hisashii* Cas12b, *Bacillus thermoamylovorans* Cas12b, *Bacillus* sp. V3-13 Cas12b, or *Alicyclobacillus acidiphilus* Cas12b.

In other embodiments, the catalytic domain is inserted between amino acid positions 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, or Cas12i. In other embodiments, the catalytic domain is inserted between amino acids P153 and S154 of BhCas12b. In other embodiments, the catalytic domain is inserted between amino acids K255 and E256 of BhCas12b. In other embodiments, the catalytic domain is inserted between amino acids D980 and G981 of BhCas12b. In other embodiments, the catalytic domain is inserted between amino acids K1019 and L1020 of BhCas12b. In other embodiments, the catalytic domain is inserted between amino acids F534 and P535 of BhCas12b. In other embodiments, the catalytic domain is inserted between amino acids K604 and G605 of BhCas12b. In other embodiments, the catalytic domain is inserted between amino acids H344 and F345 of BhCas12b. In other embodiments, catalytic domain is inserted between amino acid positions 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, or Cas12i. In other embodiments, the catalytic domain is inserted between amino acids P147 and D148 of BvCas12b. In other embodiments, the catalytic domain is inserted between amino acids G248 and G249 of BvCas12b. In other embodiments, the catalytic domain is inserted between amino acids P299 and E300 of BvCas12b. In other embodiments, the catalytic domain is inserted between amino acids G991 and E992 of BvCas12b. In other embodiments, the catalytic domain is inserted between amino acids K1031 and M1032 of BvCas12b. In other embodiments, the catalytic domain is inserted between amino acid positions 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, or Cas12i. In other embodiments, the catalytic domain is inserted between amino acids P157 and G158 of AaCas12b. In other embodiments, the catalytic domain is inserted between amino acids V258 and G259 of AaCas12b. In other embodiments, the catalytic domain is inserted between amino acids D310 and P311 of AaCas12b. In other embodiments, the catalytic domain is inserted between amino acids G1008 and E1009 of AaCas12b. In other embodiments, the catalytic domain is inserted between amino acids G1044 and K1045 at of AaCas12b.

In other embodiments, the fusion protein contains a nuclear localization signal (e.g., a bipartite nuclear localization signal). In other embodiments, the amino acid sequence of the nuclear localization signal is MAPKKKRKVGIHGVPAA (SEQ ID NO: 808). In other embodiments of the above aspects, the nuclear localization signal is encoded by the following sequence: ATGGCCC-CAAAGAAGAAGCGGAAGGTCGGTATCCACG-GAGTCCCAGCAGCC (SEQ ID NO: 809). In other embodiments, the Cas12b polypeptide contains a mutation that silences the catalytic activity of a RuvC domain. In other embodiments, the Cas12b polypeptide contains D574A, D829A and/or D952A mutations. In other embodiments, the fusion protein further contains a tag (e.g., an influenza hemagglutinin tag).

In some embodiments, the fusion protein comprises a napDNAbp domain (e.g., Cas12-derived domain) with an internally fused nucleobase editing domain (e.g., all or a portion of a deaminase domain, e.g., an adenosine deaminase domain). In some embodiments, the napDNAbp is a Cas12b. In some embodiments, the base editor comprises a BhCas12b domain with an internally fused TadA*8 domain inserted at the loci provided in Table 13B below.

TABLE 13B

| Insertion loci in Cas12b proteins | | |
|---|---|---|
| BhCas12b | Insertion site | Inserted between aa |
| position 1 | 153 | PS |
| position 2 | 255 | KE |
| position 3 | 306 | DE |
| position 4 | 980 | DG |
| position 5 | 1019 | KL |
| position 6 | 534 | FP |
| position 7 | 604 | KG |
| position 8 | 344 | HF |
| BvCas12b | Insertion site | Inserted between aa |
| position 1 | 147 | PD |
| position 2 | 248 | GG |
| position 3 | 299 | PE |
| position 4 | 991 | GE |
| position 5 | 1031 | KM |
| AaCas12b | Insertion site | Inserted between aa |
| position 1 | 157 | PG |
| position 2 | 258 | VG |
| position 3 | 310 | DP |
| position 4 | 1008 | GE |
| position 5 | 1044 | GK |

By way of nonlimiting example, an adenosine deaminase (e.g., ABE8.13) may be inserted into a BhCas12b to produce a fusion protein (e.g., ABE8.13-BhCas12b) that effectively edits a nucleic acid sequence.

Exemplary, yet nonlimiting, fusion proteins are described in U.S. Provisional Application Nos. 62/852,228 and 62/852,224, the contents of which are incorporated by reference herein in their entireties.

Methods for Editing Nucleic Acids

Some aspects of the disclosure provide methods for editing a nucleic acid. In some embodiments, the method is a method for editing a nucleobase of a nucleic acid molecule encoding a protein (e.g., a base pair of a double-stranded DNA sequence). In some embodiments, the method comprises the steps of: a) contacting a target region of a nucleic acid (e.g., a double-stranded DNA sequence) with a complex comprising a base editor and a guide nucleic acid (e.g., gRNA), b) inducing strand separation of said target region, c) converting a first nucleobase of said target nucleobase pair in a single strand of the target region to a second nucleobase, and d) cutting no more than one strand of said target region using the nCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., G•C to A•T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a methylation window.

In some embodiments, the disclosure provides methods for editing a nucleotide (e.g., SNP in a gene encoding a protein). In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Expression of Fusion Proteins in a Host Cell

Fusion proteins of the invention comprising an adenosine deaminase variant may be expressed in virtually any host cell of interest, including but not limited to bacteria, yeast, fungi, insects, plants, and animal cells using routine methods known to the skilled artisan. For example, a DNA encoding an adenosine deaminase of the invention can be cloned by designing suitable primers for the upstream and downstream of CDS based on the cDNA sequence. The cloned DNA may be directly, or after digestion with a restriction enzyme when desired, or after addition of a suitable linker and/or a nuclear localization signal ligated with a DNA encoding one or more additional components of a base editing system. The base editing system is translated in a host cell to form a complex.

A DNA encoding a protein domain described herein can be obtained by chemically synthesizing the DNA, or by connecting synthesized partly overlapping oligoDNA short chains by utilizing the PCR method and the Gibson Assembly method to construct a DNA encoding the full length thereof. The advantage of constructing a full-length DNA by chemical synthesis or a combination of PCR method or Gibson Assembly method is that the codon to be used can be designed in CDS full-length according to the host into which the DNA is introduced. In the expression of a heterologous DNA, the protein expression level is expected to increase by converting the DNA sequence thereof to a codon highly frequently used in the host organism. As the data of codon use frequency in host to be used, for example, the genetic code use frequency database disclosed in the home page of Kazusa DNA Research Institute can be used, or documents showing the codon use frequency in each host may be referred to. By reference to the obtained data and the DNA sequence to be introduced, codons showing low use frequency in the host from among those used for the DNA sequence may be converted to a codon coding the same amino acid and showing high use frequency.

An expression vector containing a DNA encoding a nucleic acid sequence-recognizing module and/or a nucleic acid base converting enzyme can be produced, for example, by linking the DNA to the downstream of a promoter in a suitable expression vector.

As the expression vector, *Escherichia coli*-derived plasmids (e.g., pBR322, pBR325, pUC12, pUC13); *Bacillus subtilis*-derived plasmids (e.g., pUB110, pTP5, pC194); yeast-derived plasmids (e.g., pSH19, pSH15); insect cell expression plasmids (e.g., pFast-Bac); animal cell expression plasmids (e.g., pA1-11, pXT1, pRc/CMV, pRc/RSV, pcDNAI/Neo); bacteriophages such as .lamda.phage and the like; insect virus vectors such as baculovirus and the like (e.g., BmNPV, AcNPV); animal virus vectors such as retrovirus, vaccinia virus, adenovirus and the like, and the like are used.

As the promoter, any promoter appropriate for a host to be used for gene expression can be used. In a conventional method using DSB, since the survival rate of the host cell sometimes decreases markedly due to the toxicity, it is desirable to increase the number of cells by the start of induction by using an inductive promoter. However, since sufficient cell proliferation can also be afforded by expressing the nucleic acid-modifying enzyme complex of the present invention, a constitution promoter can also be used without limitation.

For example, when the host is an animal cell, SR.alpha. promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. Of these, CMV promoter, SR.alpha. promoter and the like are preferable.

When the host is *Escherichia coli*, trp promoter, lac promoter, recA promoter, lamda.P.sub.L promoter, lpp promoter, T7 promoter and the like are preferable.

When the host is genus *Bacillus*, SPO1 promoter, SPO2 promoter, penP promoter and the like are preferable.

When the host is a yeast, Gall/10 promoter, PHO5 promoter, PGK promoter, GAP promoter, ADH promoter and the like are preferable.

When the host is an insect cell, polyhedrin promoter, P10 promoter and the like are preferable.

When the host is a plant cell, CaMV35S promoter, CaMV19S promoter, NOS promoter and the like are preferable.

As the expression vector, besides those mentioned above, one containing enhancer, splicing signal, terminator, polyA addition signal, a selection marker such as drug resistance gene, auxotrophic complementary gene and the like, replication origin and the like on demand can be used.

An RNA encoding a protein domain described herein can be prepared by, for example, transcription to mRNA in a vitro transcription system known per se by using a vector encoding DNA encoding the above-mentioned nucleic acid sequence-recognizing module and/or a nucleic acid base converting enzyme as a template.

A fusion protein of the invention can be intracellularly expressed by introducing an expression vector containing a DNA encoding a nucleic acid sequence-recognizing module and/or a nucleic acid base converting enzyme into a host cell, and culturing the host cell.

As the host, genus *Escherichia*, genus *Bacillus*, yeast, insect cell, insect, animal cell and the like are used.

As the genus *Escherichia*, *Escherichia coli* K12.cndot.DH1 [Proc. Natl. Acad. Sci. USA, 60, 160 (1968)], *Escherichia coli* JM103 [Nucleic Acids Research, 9, 309 (1981)], *Escherichia coli* JA221 [Journal of Molecular Biology, 120, 517 (1978)], *Escherichia coli* HB101 [Journal of Molecular Biology, 41, 459 (1969)], *Escherichia coli* C600 [Genetics, 39, 440 (1954)]and the like are used.

As the genus *Bacillus*, *Bacillus subtilis* M1114 [Gene, 24, 255 (1983)], *Bacillus subtilis* 207-21 [Journal of Biochemistry, 95, 87 (1984)]and the like are used.

As the yeast, *Saccharomyces cerevisiae* AH22, AH22R.sup.-, NA87-11A, DKD-5D, 20B-12, *Schizosaccharomyces pombe* NCYC1913, NCYC2036, *Pichia pastoris* KM71 and the like are used.

As the insect cell when the virus is AcNPV, cells of cabbage armyworm larva-derived established line (*Spodoptera frugiperda* cell; Sf cell), MG1 cells derived from the mid-intestine of *Trichoplusia ni*, High Five™ cells derived from an egg of *Trichoplusia ni*, *Mamestra brassicae*-derived cells, Estigmena acrea-derived cells and the like are used. When the virus is BmNPV, cells of *Bombyx mori*-derived established line (*Bombyx mori* N cell; BmN cell) and the like are used as insect cells. As the Sf cell, for example, Sf9 cell (ATCC CRL1711), Sf21 cell [all above, In Vivo, 13, 213-217 (1977)]and the like are used.

As the insect, for example, larva of *Bombyx mori, Drosophila*, cricket and the like are used [Nature, 315, 592 (1985)].

As the animal cell, cell lines such as monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like, pluripotent stem cells such as iPS cell, ES cell and the like of human and other mammals, and primary cultured cells prepared from various tissues are used. Furthermore, zebrafish embryo, *Xenopus* oocyte and the like can also be used.

As the plant cell, suspend cultured cells, callus, protoplast, leaf segment, root segment and the like prepared from various plants (e.g., grain such as rice, wheat, corn and the like, product crops such as tomato, cucumber, eggplant and the like, garden plants such as carnation, *Eustoma russellianum* and the like, experiment plants such as tobacco, *Arabidopsis thaliana* and the like, and the like) are used.

All the above-mentioned host cells may be haploid (monoploid), or polyploid (e.g., diploid, triploid, tetraploid and the like). In the conventional mutation introduction methods, mutation is, in principle, introduced into only one homologous chromosome to produce a hetero gene type. Therefore, desired phenotype is not expressed unless dominant mutation occurs, and homozygousness inconveniently requires labor and time. In contrast, according to the present invention, since mutation can be introduced into any allele on the homologous chromosome in the genome, desired phenotype can be expressed in a single generation even in the case of recessive mutation, which is extremely useful since the problem of the conventional method can be solved.

An expression vector can be introduced by a known method (e.g., lysozyme method, competent method, PEG method, CaCl.sub.2 coprecipitation method, electroporation method, the microinjection method, the particle gun method, lipofection method, *Agrobacterium* method and the like) according to the kind of the host.

*Escherichia coli* can be transformed according to the methods described in, for example, Proc. Natl. Acad. Sci. USA, 69, 2110 (1972), Gene, 17, 107 (1982) and the like.

The genus *Bacillus* can be introduced into a vector according to the methods described in, for example, Molecular & General Genetics, 168, 111 (1979) and the like.

A yeast can be introduced into a vector according to the methods described in, for example, Methods in Enzymology, 194, 182-187 (1991), Proc. Natl. Acad. Sci. USA, 75, 1929 (1978) and the like.

An insect cell and an insect can be introduced into a vector according to the methods described in, for example, Bio/Technology, 6, 47-55 (1988) and the like.

An animal cell can be introduced into a vector according to the methods described in, for example, Cell Engineering additional volume 8, New Cell Engineering Experiment Protocol, 263-267 (1995) (published by Shujunsha), and Virology, 52, 456 (1973).

A cell introduced with a vector can be cultured according to a known method according to the kind of the host.

For example, when *Escherichia coli* or genus *Bacillus* is cultured, a liquid medium is preferable as a medium to be used for the culture. The medium preferably contains a carbon source, nitrogen source, inorganic substance and the like necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may contain yeast extract, vitamins, growth promoting factor and the like. The pH of the medium is preferably about 5- about 8.

As a medium for culturing *Escherichia coli*, for example, M9 medium containing glucose, casamino acid [Journal of Experiments in Molecular Genetics, 431-433, Cold Spring Harbor Laboratory, New York 1972]is preferable. Where necessary, for example, agents such as 3.beta.-indolylacrylic acid may be added to the medium to ensure an efficient function of a promoter. *Escherichia coli* is cultured at generally about 15-about 43° C. Where necessary, aeration and stirring may be performed.

The genus *Bacillus* is cultured at generally about 30-about 40° C. Where necessary, aeration and stirring may be performed.

Examples of the medium for culturing yeast include Burkholder minimum medium [Proc. Natl. Acad. Sci. USA, 77, 4505 (1980)], SD medium containing 0.5% casamino acid [Proc. Natl. Acad. Sci. USA, 81, 5330 (1984)]and the like. The pH of the medium is preferably about 5-about 8. The culture is performed at generally about 20° C.-about 35° C. Where necessary, aeration and stirring may be performed.

As a medium for culturing an insect cell or insect, for example, Grace's Insect Medium [Nature, 195, 788 (1962)] containing an additive such as inactivated 10% bovine serum and the like as appropriate and the like are used. The pH of the medium is preferably about 6.2 to about 6.4. The culture is performed at generally about 27° C. Where necessary, aeration and stirring may be performed.

As a medium for culturing an animal cell, for example, minimum essential medium (MEM) containing about 5-about 20% of fetal bovine serum [Science, 122, 501 (1952)], Dulbecco's modified Eagle medium (DMEM) [Virology, 8, 396 (1959)], RPMI 1640 medium [The Journal of the American Medical Association, 199, 519 (1967)], 199 medium [Proceeding of the Society for the Biological Medicine, 73, 1 (1950)]and the like are used. The pH of the medium is preferably about 6-about 8. The culture is per-formed at generally about 30° C.-about 40° C. Where necessary, aeration and stirring may be performed.

As a medium for culturing a plant cell, for example, MS medium, LS medium, B5 medium and the like are used. The pH of the medium is preferably about 5-about 8. The culture is performed at generally about 20° C.-about 30° C. Where necessary, aeration and stirring may be performed.

When a higher eukaryotic cell, such as animal cell, insect cell, plant cell and the like is used as a host cell, a DNA encoding a base editing system of the present invention (e.g., comprising an adenosine deaminase variant) is introduced into a host cell under the regulation of an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the induction substance is added to the medium (or removed from the medium) at an appropriate stage to induce expression of the nucleic acid-modifying enzyme complex, culture is performed for a given period to carry out a base editing and, introduction of a mutation into a target gene, transient expression of the base editing system can be realized.

Prokaryotic cells such as *Escherichia coli* and the like can utilize an inducible promoter. Examples of the inducible promoter include, but are not limited to, lac promoter (induced by IPTG), cspA promoter (induced by cold shock), araBAD promoter (induced by arabinose) and the like.

Alternatively, the above-mentioned inductive promoter can also be utilized as a vector removal mechanism when higher eukaryotic cells, such as animal cell, insect cell, plant cell and the like are used as a host cell. That is, a vector is mounted with a replication origin that functions in a host cell, and a nucleic acid encoding a protein necessary for replication (e.g., SV40 on and large T antigen, oriP and EBNA-1 etc. for animal cells), of the expression of the nucleic acid encoding the protein is regulated by the above-mentioned inducible promoter. As a result, while the vector is autonomously replicatable in the presence of an induction substance, when the induction substance is removed, autonomous replication is not available, and the vector naturally falls off along with cell division (autonomous replication is not possible by the addition of tetracycline and doxycycline in Tet-OFF system vector).

Delivery System

Nucleic Acid-Based Delivery of a Nucleobase Editors and gRNAs

Nucleic acids encoding base editing systems according to the present disclosure can be administered to subjects or delivered into cells in vitro or in vivo by art-known methods or as described herein. In one embodiment, nucleobase editors can be delivered by, e.g., vectors (e.g., viral or non-viral vectors), non-vector based methods (e.g., using naked DNA, DNA complexes, lipid nanoparticles), or a combination thereof.

Nucleic acids encoding nucleobase editors can be delivered directly to cells (e.g., hematopoietic cells or their progenitors, hematopoietic stem cells, and/or induced pluripotent stem cells) as naked DNA or RNA, for instance by means of transfection or electroporation, or can be conjugated to molecules (e.g., N-acetylgalactosamine) promoting uptake by the target cells. Nucleic acid vectors, such as the vectors described herein can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and an adenosine deaminase variant (e.g., TadA*8).

The nucleic acid vector can also include any suitable number of regulatory/control elements, e.g., promoters, enhancers, introns, polyadenylation signals, Kozak consensus sequences, or internal ribosome entry sites (IRES).

according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 14 (below).

TABLE 14

| Lipids Used for Gene Transfer | | |
|---|---|---|
| Lipid | Abbreviation | Feature |
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

These elements are well known in the art. For hematopoietic cells suitable promoters can include IFNbeta or CD45.

Nucleic acid vectors according to this disclosure include recombinant viral vectors. Exemplary viral vectors are set forth herein. Other viral vectors known in the art can also be used. In addition, viral particles can be used to deliver base editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems Table 15 lists exemplary polymers for use in gene transfer and/or nanoparticle formulations.

TABLE 15

| Polymers Used for Gene Transfer | |
|---|---|
| Polymer | Abbreviation |
| Poly(ethylene)glycol | PEG |
| Polyethylenimine | PEI |
| Dithiobis (succinimidylpropionate) | DSP |
| Dimethyl-3,3'-dithiobispropionimidate | DTBP |

TABLE 15-continued

Polymers Used for Gene Transfer

| Polymer | Abbreviation |
|---|---|
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 16 summarizes delivery methods for a polynucleotide encoding a fusion protein described herein.

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris, J. A. et al., 2015, *Nat. Biotechnology*, 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

A promoter used to drive base editor coding nucleic acid molecule expression can include AAV ITR. This can be advantageous for eliminating the need for an additional promoter element, which can take up space in the vector. The additional space freed up can be used to drive the

TABLE 16

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection) | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids | expression of additional elements, such as a guide nucleic acid or a selectable marker. ITR activity is relatively weak, so it can be used to reduce potential toxicity due to over expression of the chosen nuclease.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

In some embodiments, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

In some embodiments, the methods described herein for editing specific genes in an immune cell can be used to genetically modify a CAR-T cell. Such CAR-T cells, and methods to produce such CAR-T cells are described in International Application Nos. PCT/US2016/060736, PCT/US2016/060734, PCT/US2016/034873, PCT/US2015/040660, PCT/EP2016/055332, PCT/IB2015/058650, PCT/EP2015/067441, PCT/EP2014/078876, PCT/EP2014/059662, PCT/IB2014/061409, PCT/US2016/019192, PCT/US2015/059106, PCT/US2016/052260, PCT/US2015/020606, PCT/US2015/055764, PCT/CN2014/094393, PCT/US2017/059989, PCT/US2017/027606, and PCT/US2015/064269, the contents of each is hereby incorporated in its entirety.

Viral Vectors

A base editor described herein can therefore be delivered with viral vectors. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other embodiments, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors can also be used to transduce cells with target nucleic acids, e.g., in the in vitro production of nucleic acids and peptides, and for in vivo and ex vivo gene therapy procedures (See, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs). This means disclosed base editor as well as a promoter and transcription terminator can fit into a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OptiMEM (serum-free) media and transfection was done 4 hours later. Cells are transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection can be done in 4 mL OptiMEM with a cationic lipid delivery agent (50 μl Lipofectamine 2000 and 100 μl Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 μm low protein binding (PVDF) filter. They are then spun in an ultracentrifuge for 2 hours at 24,000 rpm. Viral pellets are resuspended in 50 μl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors are contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GC-CACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

Inteins (intervening protein) are auto-processing domains found in a variety of diverse organisms, which carry out a process known as protein splicing. Protein splicing is a multi-step biochemical reaction comprised of both the cleavage and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio)esterification by nucleophilic attack of the first C-extein residue (+1), which is a cysteine, serine, or threonine. The resulting branched (thio)ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, an N-terminal fragment of a base editor (e.g., ABE, CBE) is fused to a split intein-N and a C-terminal fragment is fused to a split intein-C. These fragments are then packaged into two or more AAV vectors. The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis. The N-terminus of each fragment is fused to an intein-N and the C- terminus of each fragment is fused to an intein C at amino acid positions S303, T310, T313, S355, A456, S460, A463, T466, S469, T472, T474, C574, S577, A589, and S590, which are indicated in bold capital letters in the sequence below.

```
                                 (SEQ ID NO: 810)
   1 mdkkysigld igtnsvgwav itdeykvpsk kfkvlgntdr
     hsikknliga llfdsgetae 61 atrlkrtarr rytrrknric ylgeifsnem akvddsffhr
     leesflveed kkherhpifg 121 nivdevayhe kyptiyhlrk klvdstdkad lrliylalah
     mikfrghfli egdlnpdnsd 181 vdklfiglvg tynqlfeenp inasgvdaka ilsarlsksr
     rlenliaqlp gekknglfgn 241 lialslgltp nfksnfdlae daklqlskdt ydddldnlla
     gigdqyadlf laaknlsdai 301 llSdilrvnT eiTkaplsas mikrydehhq dltllkalvr
     qqlpekykei ffdqSkngya 361 gyidggasqe efykfikpil ekmdgteell vklnredllr
     kqrtfdngsi phqihlgelh 421 ailrrqedfy pflkdnreki ekiltfripy yvgplArgnS
     rfAwmTrkSe eTiTpwnfee 481 vvdkgasaqs fiermtnfdk nlpnekvlpk hsllyeyftv
     yneltkvkyv tegmrkpafl 541 sgeqkkaivd llfktnrkvt vkqlkedyfk kieCfdSvei
     sgvedrfnAS lgtyhdllki 601 ikdkdfldne enedilediv ltltlfedre mieerlktya
     hlfddkvmkg lkrrrytgwg 661 rlsrklingi rdkqsgktil dflksdgfan rnfmqlihdd
     sltfkediqk aqvsgqgdsl 721 hehianlags paikkgilqt vkvvdelvkv mgrhkpeniv
     iemarengtt qkgqknsrer 781 mkrieegike lgsqilkehp ventqlqnek lylyylqngr
     dmyvdgeldi nrlsdydvdh 841 ivpqsflkdd sidnkvltrs dknrgksdnv pseevvkkmk
     nywrqllnak litgrkfdnl 901 tkaergglse ldkagfikrq lvetrqitkh vaqildsrmn
     tkydendkli revkvitlks 961 klvsdfrkdf qfykvreinn yhhandayln avvgtalikk
     ypklesefvy gdykvydvrk 1021 miakseqeig katakyffys nimnffktei tlangeirkr
     plietngetg eivwdkgrdf 1081 atvrkvlsmp qvnivkktev qtggfskesi lpkrnsdkli
     arkkdwdpkk yggfdsptva 1141 ysvlvvakve kgkskklksv kellgitime rssfeknpid
     fleakgykev kkdliiklpk 1201 yslfelengr krmlasagel qkgnelalps kyvnflylas
     hyeklkgspe dneqkqlfve 1261 qhkhyldeii eqisefskry iladanldkv lsaynkhrdk
     pireqaenii hlftltnlga 1321 paafkyfdtt idrkrytstk evldatlihq sitglyetri
     dlsqlggd
```

Use of Nucleobase Editors to Target Mutations

The suitability of nucleobase editors that targets a mutation is evaluated as described herein. In one embodiment, a single cell of interest is transduced with a base editing system together with a small amount of a vector encoding a reporter (e.g., GFP). These cells can be any cell line known in the art, including immortalized human cell lines, such as 293T, K562 or U20S. Alternatively, primary cells (e.g., human) may be used. Such cells may be relevant to the eventual cell target.

Delivery may be performed using a viral vector. In one embodiment, transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors are used to target polynucleotides of interest. In one embodiment, a nucleobase editor of the invention is delivered to cells (e.g., hematopoietic cells or their progenitors, hematopoietic stem cells, and/or induced pluripotent stem cells) in conjunction with a guide RNA that is used to target a mutation of interest within the genome of a cell, thereby altering the mutation. In some embodiments, a base editor is targeted by a guide RNA to introduce one or more edits to the sequence of a gene of interest.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at the Kazusa Codon Usage Database website, and these tables can be adapted in a number of ways. See, Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

Pharmaceutical Compositions

Other aspects of the present disclosure relate to pharmaceutical compositions comprising any of the genetically modified immune cells, base editors, fusion proteins, or the fusion protein-guide polynucleotide complexes described herein. The term "pharmaceutical composition," as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

In some embodiments, the present invention provides a pharmaceutical composition comprising a genetically modified immune cell of the present invention. More specifically, provided herein are pharmaceutical compositions comprising a genetically modified immune cell, or a population of such immune cells, expressing a chimeric antigen receptor, wherein said modified immune cell, or a population thereof, has at least one edited gene edited to enhance the function of the modified immune cell or to reduce immunosuppression or inhibition of the modified immune cell, wherein expression of the edited gene is either knocked out or knocked down. In some embodiments the at least one edited gene is TRAC, B2M, PDCD1, CBLB, CD7, CIITA, TGFBR2, ZAP70, NFATcT, TET2, or combinations thereof.

In addition to the modified immune cell, or population thereof, and the carrier, the pharmaceutical compositions of the present invention can include at least one additional therapeutic agent useful in the treatment of disease. For example, some embodiments of the pharmaceutical composition described herein further comprise a chemotherapeutic agent. In some embodiments, the pharmaceutical composition further comprises a cytokine peptide or a nucleic acid sequence encoding a cytokine peptide. In some embodiments, the pharmaceutical compositions comprising the modified immune cell or population thereof can be administered separately from an additional therapeutic agent.

The pharmaceutical compositions of the present invention can be used to treat any disease or condition that is responsive to autologous or allogeneic immune cell immunotherapy. For example, the pharmaceutical compositions, in some embodiments are useful in the treatment of neoplasia. In some embodiments, the neoplasia is a hematological cancer. In some embodiments, the hematological cancer is a B cell cancer, and in some embodiments, the B cell cancer is multiple myeloma. In some embodiments, the B cell cancer is relapsed of relapsed/refractory multiple myeloma.

One consideration concerning the therapeutic use of genetically modified immune cells of the invention is the quantity of cells necessary to achieve an optimal or satisfactory effect. The quantity of cells to be administered may vary for the subject being treated. In one embodiment, between $10^4$ to $10^{10}$, between $10^5$ to $10^9$, or between $10^6$ and $10^8$ genetically modified immunoresponsive cells of the invention are administered to a human subject. In some embodiments, at least about $1\times10^8$, $2\times10^8$, $3\times10^8$, $4\times10^8$, and $5\times10^8$ genetically modified immune cells of the invention are administered to a human subject. Determining the precise effective dose may be based on factors for each individual subject, including their size, age, sex, weight, and condition. Dosages can be readily ascertained by those skilled in the art from this disclosure and the knowledge in the art.

The pharmaceutical compositions of the present invention can be prepared in accordance with known techniques. See, e.g., Remington, The Science And Practice of Pharmacy (21st ed. 2005). In general, the immune cell, or population thereof is admixed with a suitable carrier prior to administration or storage, and in some embodiments, the pharmaceutical composition further comprises a pharmaceutically acceptable carrier. As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Suitable pharmaceutically acceptable carriers generally comprise inert substances that aid in administering the pharmaceutical composition to a subject, aid in processing the pharmaceutical compositions into deliverable preparations, or aid in storing the pharmaceutical composition prior to administration. Pharmaceutically acceptable carriers can include agents that can stabilize, optimize or otherwise alter the form, consistency, viscosity, pH, pharmacokinetics, solubility of the formulation. Such agents include buffering agents, wetting agents, emulsifying agents, diluents, encapsulating agents, and skin penetration enhancers. For example, carriers can include, but are not limited to, saline, buffered saline, dextrose, arginine, sucrose, water, glycerol, ethanol, sorbitol, dextran, sodium carboxymethyl cellulose, and combinations thereof.

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient," "carrier," "pharmaceutically acceptable carrier," "vehicle" or the like are used interchangeably herein.

The skilled artisan can readily determine the number of cells and amount of optional additives, vehicles, and/or carriers in compositions and to be administered in methods of the invention. Typically, additives (in addition to the active immune cell(s)) are present in an amount of 0.001 to 50% (weight) solution in phosphate buffered saline, and the active ingredient is present in the order of micrograms to milligrams, such as about 0.0001 to about 5 wt %, preferably about 0.0001 to about 1 wt %, still more preferably about 0.0001 to about 0.05 wt % or about 0.001 to about 20 wt %, preferably about 0.01 to about 10 wt %, and still more preferably about 0.05 to about 5 wt %. Of course, for any composition to be administered to an animal or human, and for any particular method of administration, it is preferred to determine therefore: toxicity, such as by determining the lethal dose (LD) and LD50 in a suitable animal model (e.g., a rodent such as a mouse); and, the dosage of the composition(s), concentration of components therein, and the timing of administering the composition(s), which elicit a suitable response. Such determinations do not require undue experimentation from the knowledge of the skilled artisan, this disclosure and the documents cited herein. And, the time for sequential administrations can be ascertained without undue experimentation.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228: 190; During et al., 1989, Ann. Neurol. 25:351; Howard et ah, 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6: 1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131

(Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions.

Methods of Treatment

Some aspects of the present invention provide methods of treating a subject in need, the method comprising administering to a subject in need an effective therapeutic amount of a pharmaceutical composition as described herein. More specifically, the methods of treatment comprise administering to a subject in need thereof a pharmaceutical composition comprising a population of modified immune cells expressing a chimeric receptor and having at least one edited gene, wherein the at least one edited gene enhances the function or reduces the immunosuppression or inhibition of the modified immune cell, and wherein expression of the at least one edited gene is either knocked out or knocked down. In some embodiments, the method of treatment is an autologous immune cell therapy. In other embodiments, the method of treatment is an allogeneic immune cell therapy.

In certain embodiments, the specificity of an immune cell is redirected to a marker expressed on the surface of a diseased or altered cell in a subject by genetically modifying the immune cell to express a chimeric antigen receptor contemplated herein. In some embodiments, the method of treatment comprises administering to a subject an immune cell as described herein, wherein the immune cell has been genetically modified to redirect its specificity to a marker expressed on a neoplastic cell. In some embodiments, the neoplasia is a B cell cancer; for example, a B cell cancer such as a lymphoma, leukemia, or a myeloma, for example, multiple myeloma. Thus, some embodiments of the present disclosure provide a method of treating a neoplasia in a subject. In some embodiments, the neoplasia being treated is a B cell cancer. In some embodiments, the B cell cancer is a lymphoma, leukemia, or multiple myeloma.

Some embodiments of the methods of treating a neoplasia in a subject comprise administering to the subject an immune cell as described herein and one or more additional therapeutic agents. For example, the immune cell of the present invention can be co-administered with a cytokine. In some embodiments, the cytokine is IL-2, IFN-α, IFN-γ, or a combination thereof. In some embodiments, the immune cell is co-administered with a chemotherapeutic agent. The chemotherapeutic can be cyclophosphamide, doxorubicin, vincristine, prednisone, or rituximab, or a combination thereof. Other chemotherapeutics include obinutuzumab, bendamustine, chlorambucil, cyclophosphamide, ibrutinib, methotrexate, cytarabine, dexamethasone, cisplatin, bortezomib, fludarabine, idelalisib, acalabrutinib, lenalidomide, venetoclax, cyclophosphamide, ifosfamide, etoposide, pentostatin, melphalan, carfilzomib, ixazomib, panobinostat, daratumumab, elotuzumab, thalidomide, lenalidomide, or pomalidomide, or a combination thereof "Co-administered" refers to administering two or more therapeutic agents or pharmaceutical compositions during a course of treatment. Such co-administration can be simultaneous administration or sequential administration. Sequential administration of a later-administered therapeutic agent or pharmaceutical composition can occur at any time during the course of treatment after administration of the first pharmaceutical composition or therapeutic agent.

In some embodiments, the methods of treatment comprise administering to a subject having an effective amount of a CAR-T cell that lacks or has reduced levels of functional T Cell Receptor Alpha Constant (TRAC), beta2 microglobulin (B2M), Cluster of Differentiation 7 (CD7), Programmed Cell Death 1 (PDCD1), Cbl Proto-Oncogene B (CBLB), and/or Class II Major Histocompatibility Complex Transactivator (CIITA). In some embodiments, the methods of treatment comprise administering to a subject having or having a propensity to develop graft-versus-host disease (GVHD) an effective amount of a CAR-T cell that lacks or has reduced levels of functional TRAC. In some embodiments, the methods of treatment comprise administering to a subject having or having a propensity to develop host-versus-graft disease (HVGD) an effective amount of a CAR-T cell that lacks or has reduced levels of functional B2M.

In some embodiments of the present invention, an administered immune cell proliferates in vivo and can persist in the subject for an extended period of time. Immune cells of the present invention, in some embodiments can mature into memory immune cells and remain in circulation within the subject, thereby generating a population of cells able to actively respond to recurrence of a diseased or altered cell expressing the marker recognized by the chimeric antigen receptor.

Administration of the pharmaceutical compositions contemplated herein may be carried out using conventional techniques including, but not limited to, infusion, transfusion, or parenterally. In some embodiments, parenteral administration includes infusing or injecting intravascularly, intravenously, intramuscularly, intraarterially, intrathecally, intratumorally, intradermally, intraperitoneally, transtracheally, subcutaneously, subcuticularly, intraarticularly, subcapsularly, subarachnoidly and intrastemally.

Kits, Vectors, Cells

Various aspects of this disclosure provide kits comprising a base editor system. In one embodiment, the kit comprises a nucleic acid construct comprising a nucleotide sequence encoding a nucleobase editor fusion protein. The fusion protein comprises a deaminase (e.g. cytidine deaminase or adenine deaminase) and a nucleic acid programmable DNA binding protein (napDNAbp). In some embodiments, the kit comprises at least one guide RNA capable of targeting a nucleic acid molecule of interest. In some embodiments, the kit comprises a nucleic acid construct comprising a nucleotide sequence encoding at least one guide RNA.

The invention also provides kits comprising a nucleic acid construct comprising a nucleotide sequence encoding an adenosine deaminase nucleobase editor (e.g., ABE8) at least two guide RNAs, each guide RNA having a nucleic acid sequence at least 85% complementary to a nucleic acid sequence of gene encoding TRAC, CD7, B2M, PD1, CBLB, and/or CIITA. In some embodiments, the nucleotide sequence encoding the adenosine deaminase (e.g., TadA*8) comprises a heterologous promoter that drives expression of the adenosine deaminase nucleobase editor (e.g., ABE8).

Some aspects of this disclosure provide kits comprising a nucleic acid construct, comprising (a) a nucleotide sequence encoding (a) a Cas9 domain fused to an adenosine deaminase (e.g., TadA*8) as provided herein; and (b) a heterologous promoter that drives expression of the sequence of (a).

Some aspects of this disclosure provide kits for the treatment of a neoplasia comprising a modified immune cell or immune cell having reduced immunogenicity and enhanced anti-neoplasia activity. In some embodiments, the immune or immune cell comprising a mutation in a TRAC, CD7, B2M, PD1, CBLB, and/or CIITA polypeptide, or a combination thereof. In some embodiments, the modified immune cell further comprises a chimeric antigen receptor having an affinity for a marker associated with the neoplasia. The neoplasia treatment kits comprise written instructions for using the modified immune cells in the treatment of the neoplasia.

The kit provides, in some embodiments, instructions for using the kit to edit one or more mutations. The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Single and Multiplex Editing of Targets in Primary Human T Cells

Chimeric antigen receptor-T cell (CAR-T) therapies have demonstrated significant efficacy in treating some cancers (June, C. H. & Sadelain, M., Chimeric Antigen Receptor Therapy. N Engl J Med 379, 64-73, doi:10.1056/ NEJMra1706169 (2018)). However, generating autologous CAR-T therapies on a per-patient basis is logistically challenging, and lengthy manufacturing times can be clinically burdensome for patients. To alleviate these issues, universally compatible CAR-T cell strategies have been developed, enabling cells taken from a single donor to be used to treat many patients (Themeli, M., Riviere, I. & Sadelain, M., New cell sources for T cell engineering and adoptive immunotherapy. Cell Stem Cell 16, 357-366, doi:10.1016/ j.stem.2015.03.011 (2015)). These cells must be modified to reduce alloreactivity against the recipient, as well as the host's ability to recognize the graft cells (Qasim, W. et al. Molecular remission of infant B-ALL after infusion of universal TALEN gene-edited CAR T cells. Sci Transl Med 9, doi:10.1126/scitranslmed.aaj2013 (2017); Ren, J. et al. Multiplex Genome Editing to Generate Universal CAR T Cells Resistant to PD1 Inhibition. Clin Cancer Res 23, 2255-2266, doi:10.1158/1078-0432.CCR-16-1300 (2017)).

Genetically modified T cells have demonstrated clinical efficacy in some therapeutic applications (June, C. H. & Sadelain, M. Chimeric Antigen Receptor Therapy. N Engl J Med 379, 64-73, doi:10.1056/NEJMra1706169 (2018)) and there is an increasing body of evidence suggesting that the therapeutic potential of adoptive T cell therapies may be significantly enhanced by disruption of multiple genes in the same cell to achieve desirable cellular phenotypes (Depil, S., et al. 'Off-the-shelf' allogeneic CAR T cells: development and challenges. Nat Rev Drug Discov, doi:10.1038/s41573-019-0051-2 (2020); Stadtmauer, E. A. et al. First-in-Human Assessment of Feasibility and Safety of Multiplexed Genetic Engineering of Autologous T Cells Expressing NY-ESO -1 TCR and CRISPR/Cas9 Gene Edited to Eliminate Endogenous TCR and PD-1 (NYCE T cells) in Advanced Multiple Myeloma (MM) and Sarcoma. Blood 134, 49, doi:10.1182/ blood-2019-122374 (2019)). Approaches using nucleases to introduce INDEL mutations in target genes, thereby knocking down their expression in donor T cells (Qasim, W. et al. Molecular remission of infant B-ALL after infusion of universal TALEN gene-edited CAR T cells. Sci Transl Med 9, doi:10.1126/scitranslmed.aaj2013 (2017); Ren, J. et al. Multiplex Genome Editing to Generate Universal CAR T Cells Resistant to PD1 Inhibition. Clin Cancer Res 23, 2255-2266, doi:10.1158/1078-0432.CCR-16-1300 (2017)) are effective, but simultaneous creation of multiple DSBs in a target cell can result in genomic rearrangements with variable frequencies (Webber, B. R. et al., Highly efficient multiplex human T cell engineering without double-strand breaks using Cas9 base editors. Biorxiv, doi:10.1101/ 482497 (2018); Poirot, L. et al., Multiplex Genome-Edited T-cell Manufacturing Platform for "Off-the-Shelf" Adoptive T-cell Immunotherapies. Cancer Res 75, 3853-3864, doi: 10.1158/0008-5472.CAN-14-3321 (2015)). Because ABEs function by making single nucleotide genomic changes without creating DSBs, multiplex base editing with ABE8 is an attractive approach for creating genetically modified T cells.

Figure 2A:
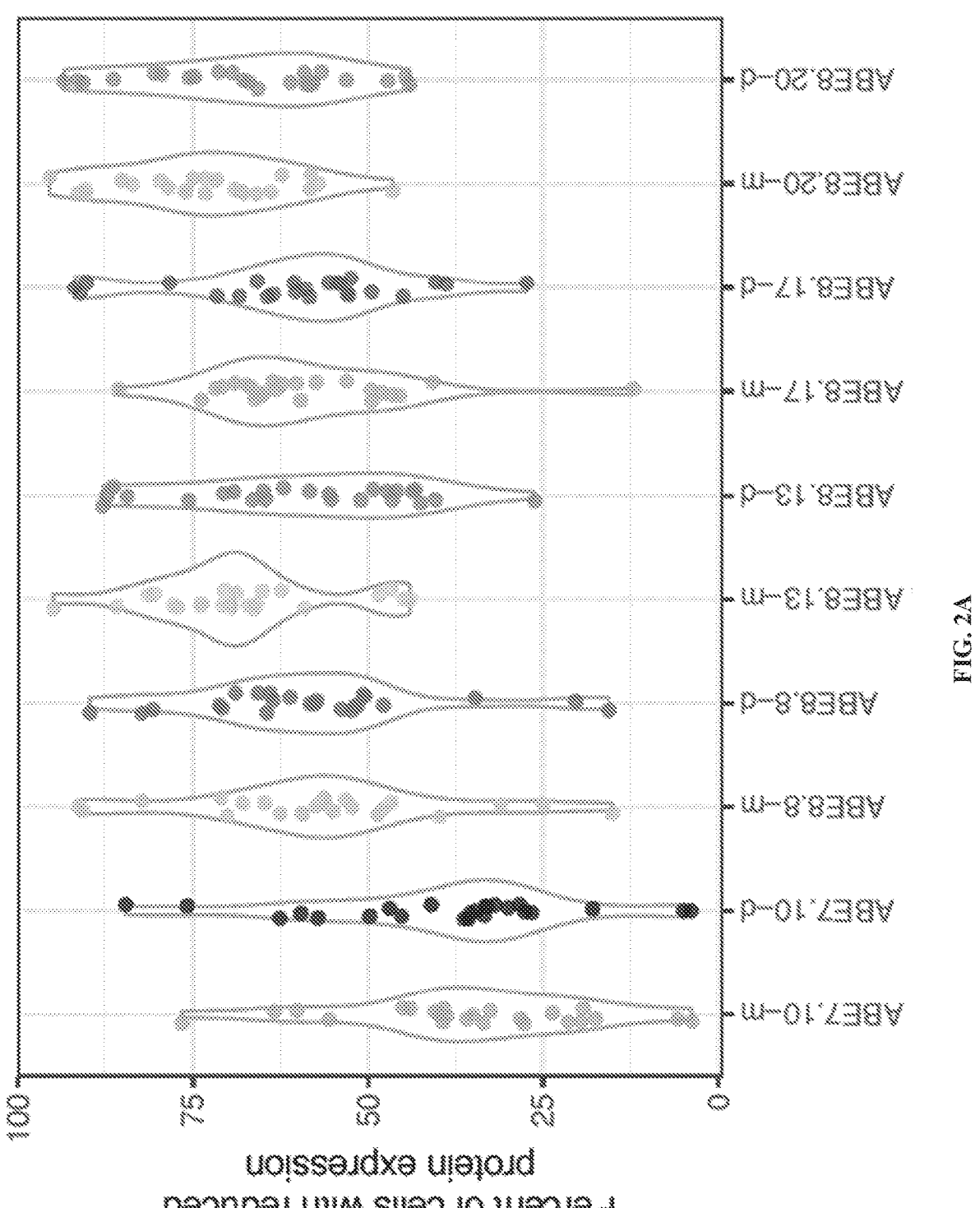
FIGS. 2A-2D depict A•T to G•C conversion and phenotypic outcomes in primary cells.
Figure 2B:
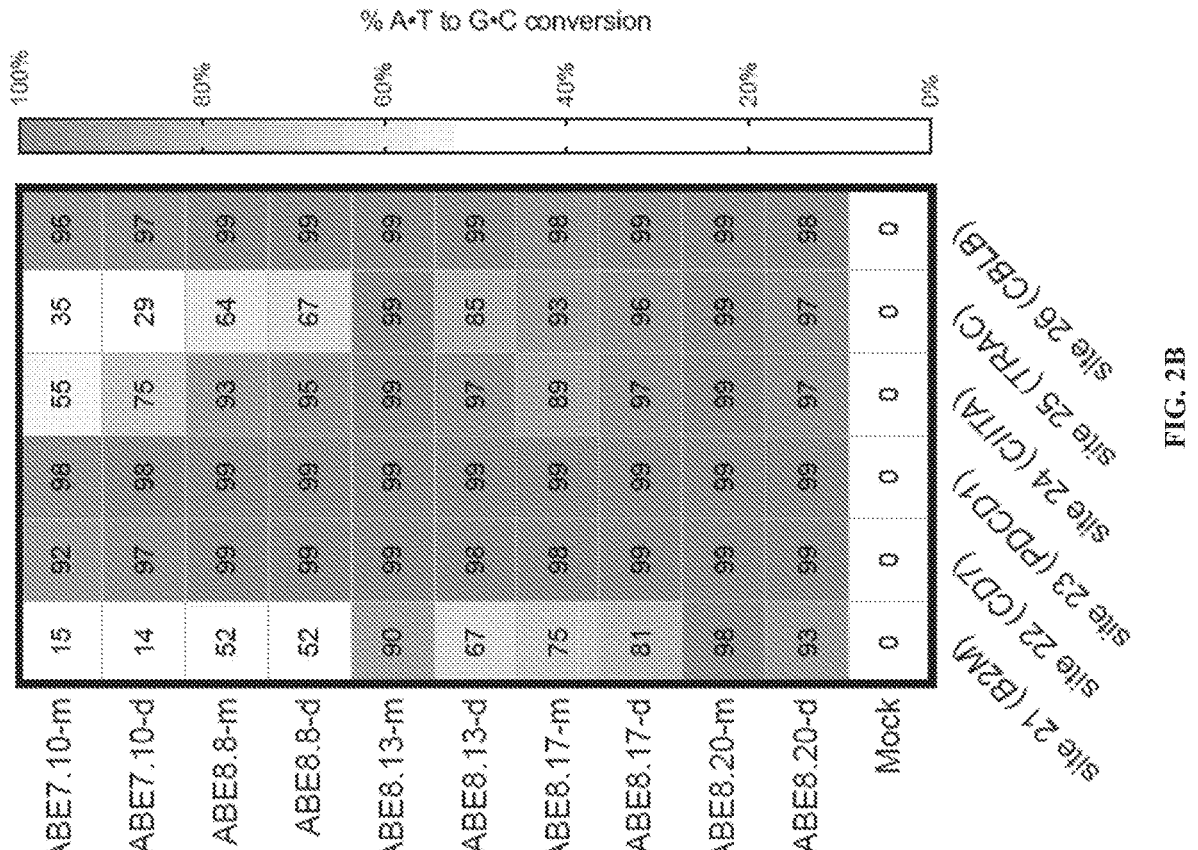
Figure 3:
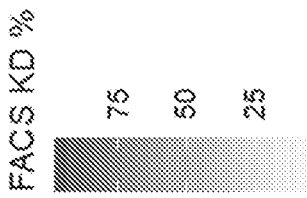
FIG. 3 is a heat map depicting protein knockdown measured by flow cytometry by ABE editors in primary T cells. Eight mRNAs encoding ABE8 editors and two mRNAs encoding ABE7.10-m/d were individually transfected into T cells with 41 sgRNAs targeting six genes and their effects on protein expression were measured using flow cytometry. Values shown are the mean of n=2 independent replicates.

First, to determine whether ABE8 could be used to prevent the expression of single genes relevant to the creation of universal CAR-T therapies, conserved sequence motifs were targeted at mRNA splice sites (B2M, CD7, PDCD1, CIITA, TRAC, and CBLB) using a strategy used previously with cytosine base editors (see Webber, B. R. et al. Highly efficient multiplex human T cell engineering without double-strand breaks using Cas9 base editors. Biorxiv, doi:10.1101/482497 (2018)). Eight (8) of the highest-performing ABE8s, in addition to ABE7.10, were screened for activity by individually transfecting primary human T cells with mRNA encoding each editor and 41 sgRNAs targeting six total genes, and protein knockdown was measured by flow cytometry as a proxy for genomic editing (FIG. 2A). Across all sgRNAs, ABE7.10 induced protein knockdown with between 2%-85% efficiency (median of 20.7% and 26.4% for ABE7.10-m and ABE7.10-d, respectively). Although all ABE8s outperformed their ABE7.10 counterparts, ABE8.20-m consistently produced the highest protein knockdown efficiencies (range of 4%-96%, median of 60%; FIG. 2A). The genomic editing efficiencies and the best performing target site for each gene was then measured using NGS (FIG. 2B, sites identified in FIG. 3). ABE7.10-m/d edited the six target sites with between 14-98% efficiency, while ABE8.20-m edited each of the same sites with between 98-99% efficiency.

Figure 2C:
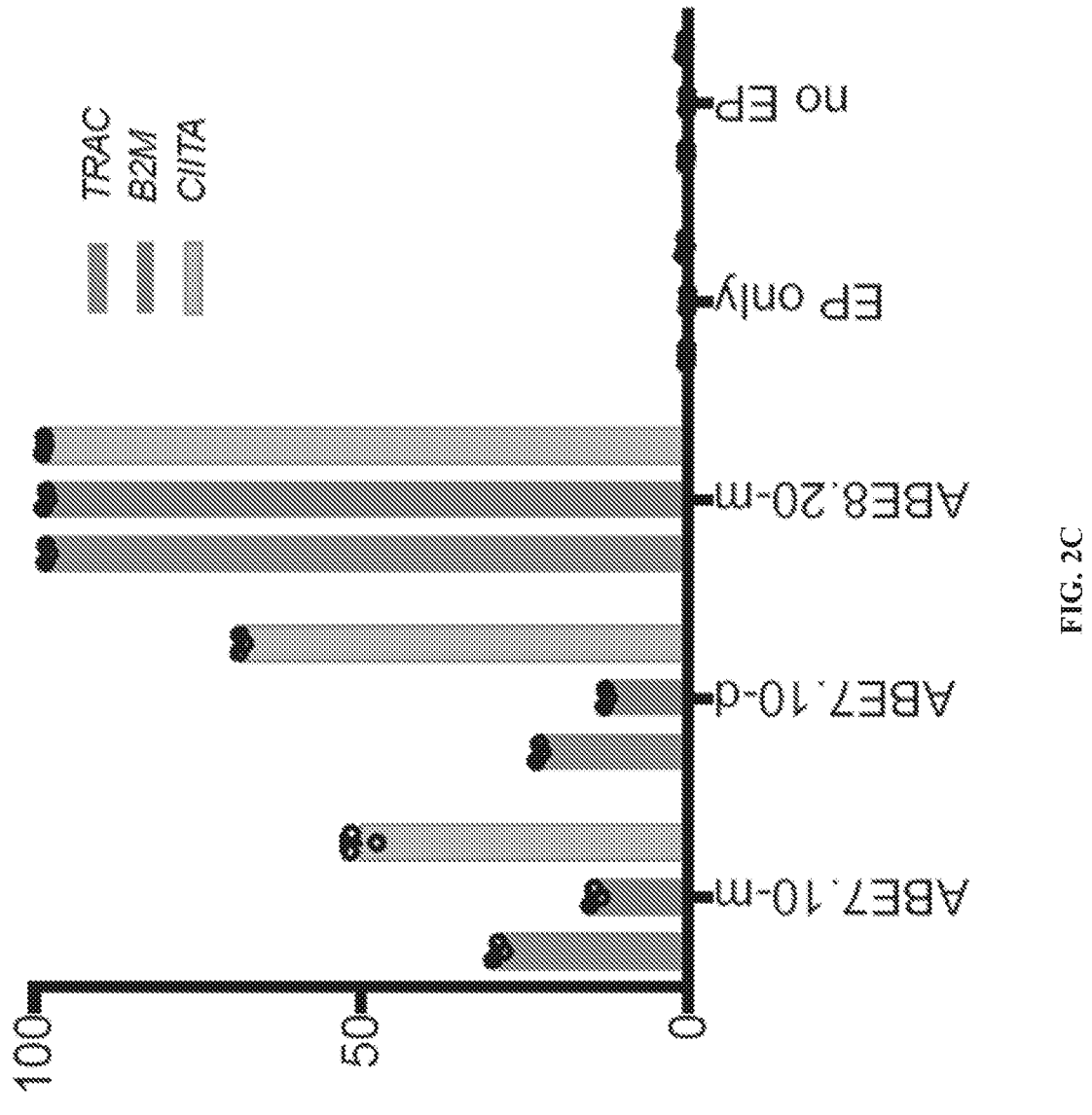
Figure 2D:
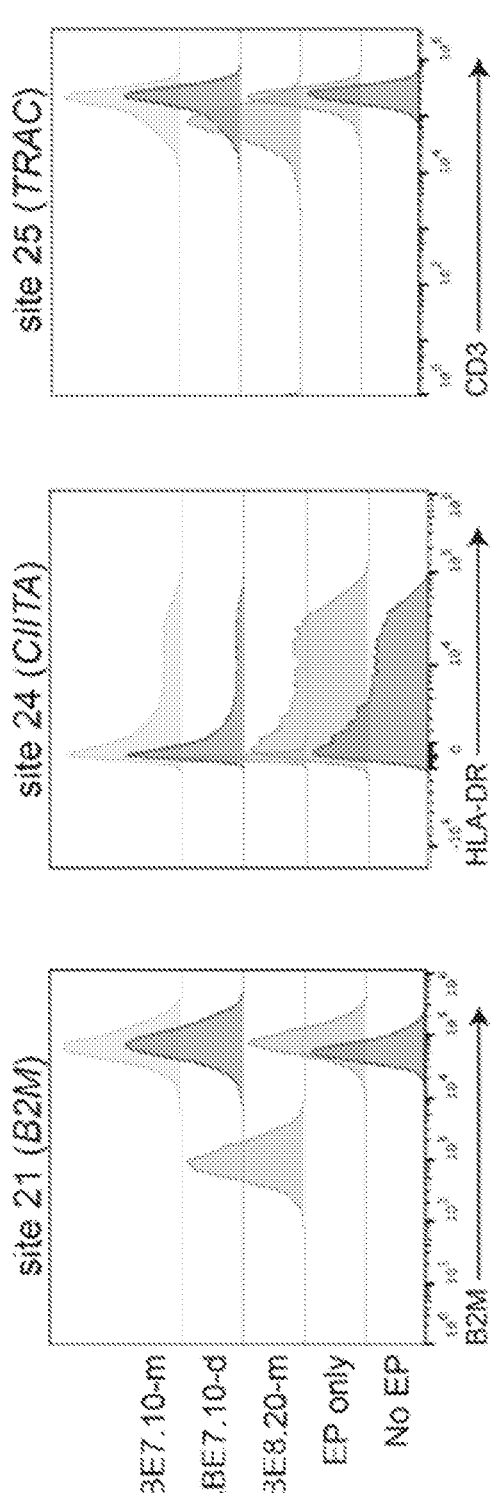

To determine whether ABE8.20-m is capable of efficient multiplexed editing, editing three genes simultaneously was tested in primary human T cells. B2M, CIITA, and TRAC were targeted. These genes when knocked out confer reduced cell surface expression of MHC class I, MHC class II, and the T cell receptor (Qasim, W. et al. Molecular remission of infant B-ALL after infusion of universal TALEN gene-edited CAR T cells. Sci Transl Med 9, doi:10.1126/scitranslmed.aaj2013 (2017); Serreze, D. V., et al. Major histocompatibility complex class I-deficient NOD-B2M null mice are diabetes and insulitis resistant. Diabetes 43, 505-509, doi:10.2337/diab.43.3.505 (1994); LeibundGut-Landmann, S. et al. Mini-review: Specificity and expression of CIITA, the master regulator of MHC class II genes. Eur J Immunol 34, 1513-1525, doi:10.1002/eji.200424964 (2004)), respectively, phenotypes which are hypothesized to reduce alloreactivity and immune recognition in the context of allogenic cell therapies. ABE8.20-m edited each individual target with 98.1%, 98.3%, or 98.6% efficiency, improvements of 3.4, 6.9, and 1.4-fold over ABE7.10 (FIG. 2C). DNA editing efficiency correlated with reduced cell surface expression of B2M, HLA-DR and CD3 (FIG. 2D).

Figure 4:
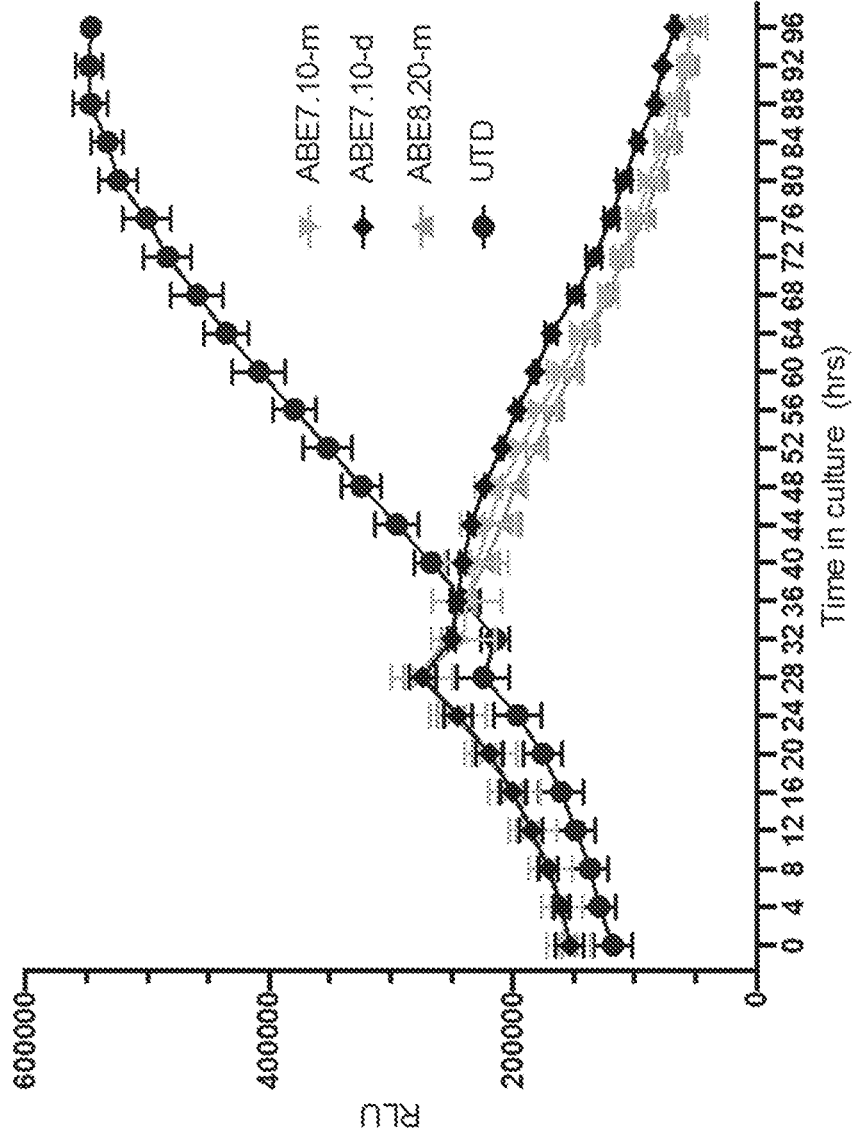
FIG. 4 is a graph depicting ABE edited CAR-T cells possessing potent cytotoxic activity in response to antigen-positive tumor cells. Fluorescently-tagged RPMI-8226 cells were seeded at time=0 hours and their growth was monitored using an IncuCyte live cell imaging system over 28 hours before introduction of CAR-T cells. T cells that were multiplex-edited using the indicated ABE (FIG. 1C) were transduced with lentivirus encoding an anti-BCMA CAR molecule and were introduced to the RPMI-8226 cells at time=28 hours, and the growth of RPMI-8226 cells was monitored over an additional 68 hours. Values shown are the mean of n=3 independent biological replicates.

However, >98% genomic editing of the TRAC locus by ABE8.20-m resulted in only moderately reduced trafficking of the T cell receptor to the cell surface, indicating that modification of splice sites by ABE8 does not always fully abrogate mRNA splicing and that protein expression must also be stringently evaluated for each sgRNA. Even with incomplete TRAC protein knockdown, ABE8.20-m produced approximately 34.8% cells with reduced protein expression of all three targets, while ABE7.10-m/d produced a negligible number of triple-knockdown cells (FIG. 2D). Further, the addition of a CAR transgene by lentiviral transduction to the B2M/CIITA/TRAC-edited cells yielded anti-BCMA CAR-Ts with robust cytotoxicity in response to antigen-positive tumor cells (FIG. 4). ABE8s demonstrate the potential for adenine base editing to create highly engineered cell therapies for single and multiplex editing, achieving base editing efficiencies of 98-99% across six target gene loci, which can confer a range of desirable therapeutic attributes.

Example 2: Whole Transcriptome Sequencing

Figures 8A, 8B:
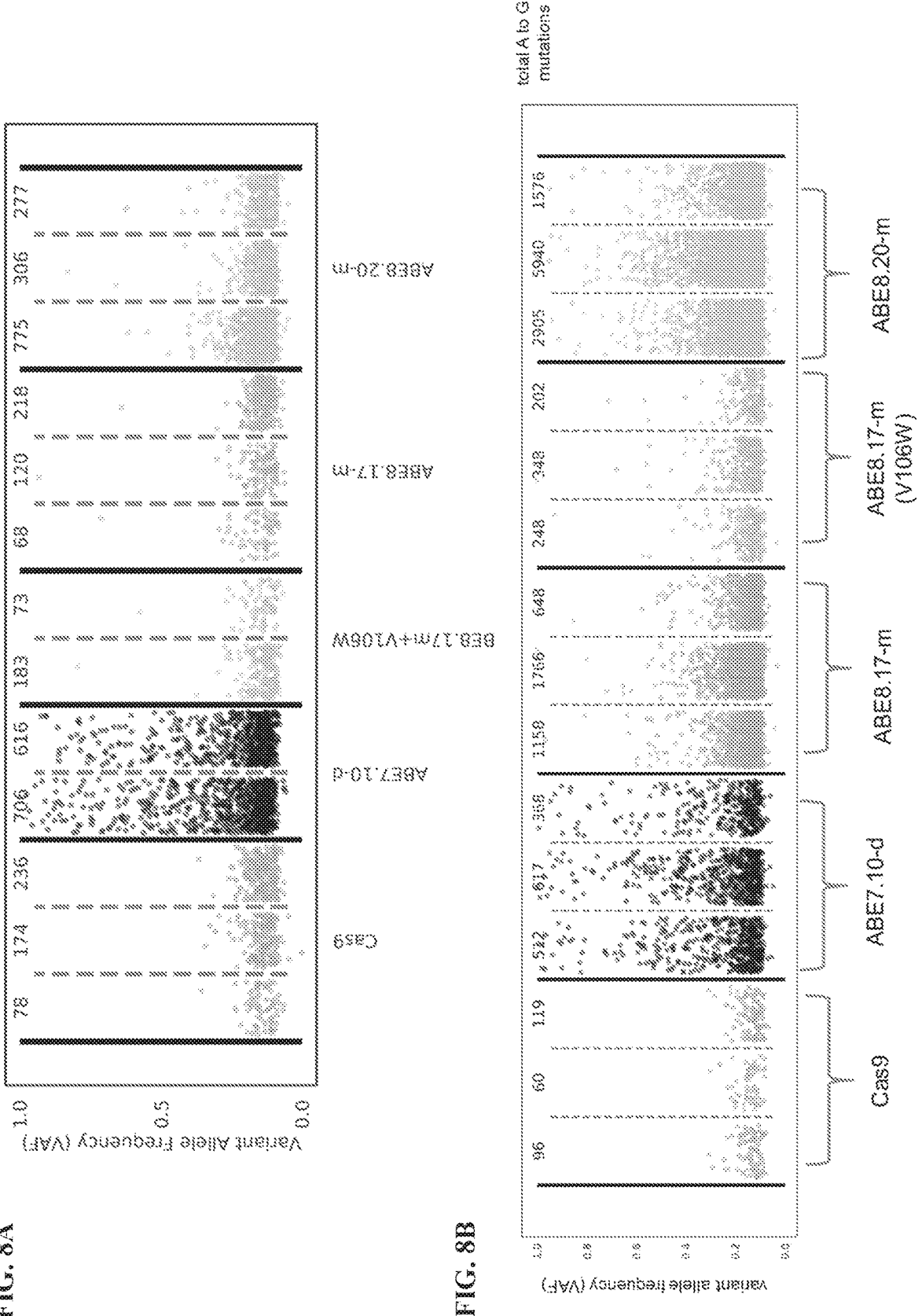
FIGS. 8A and 8B depict whole transcriptome and whole genome sequencing data from cells treated with base editor mRNAs.

To examine spurious cellular RNA deamination, whole transcriptome sequencing was performed of both HEK293T and human T cells treated with ABE7.10-d, ABE8.17-m, ABE8.20-m and ABE8.17-m+V106W-encoding mRNAs (FIG. 8A for HEK293T cells and FIG. 8B for T cells). In both cell types, transcriptome-wide sequencing revealed a detectable increase in cellular adenine deamination in cells treated with ABE7.10-d, ABE8.17-m and ABE8.20-m relative to a Cas9 control (FIGS. 8A and 8B). However, the elevated frequency of mRNA deamination is mitigated by inclusion of the V106W mutation in the ABE8.17m+V106W-treated samples (FIG. 8A for HEK293T cells and FIG. 8B for T cells), indicating that choice of editor and delivery modality can mitigate and, in some cases, eliminate off-target cellular RNA deamination arising from ABE treatment for applications where transient RNA editing is of concern.

Example 3: Materials and Methods

General Methods:

All cloning was conducted via USER enzyme (New England Biolabs) cloning methods (see Geu-Flores et al., USER fusion: a rapid and efficient method for simultaneous fusion and cloning of multiple PCR products. *Nucleic Acids Res* 35, e55, doi:10.1093/nar/gkm106 (2007)) and templates for PCR amplification were purchased as bacterial or mammalian codon optimized gene fragments (GeneArt). Vectors created were transformed into Mach T1$^R$ Competent Cells (Thermo Fisher Scientific) and maintained at -80 C for long-term storage. Primers were purchased from Integrated DNA Technologies and PCRs were carried out using either Phusion U DNA Polymerase Green MultiPlex PCR Master Mix (ThermoFisher) or Q5 Hot Start High-Fidelity 2x Master Mix (New England Biolabs). Plasmids were freshly prepared from 50 mL of Machi culture using ZymoPURE Plasmid Midiprep (Zymo Research Corporation), which involves an endotoxin removal procedure. Molecular biology grade Hyclone water (GE Healthcare Life Sciences) was used in all assays, transfections, and PCR reactions to ensure exclusion of DNAse activity.

Amino acid sequences of sgRNAs used for Hek293T mammalian cell transfection are provided in Table 17 below. The 20-nt target protospacer is shown in bold font. When a target DNA sequence did not start with a 'G,' a 'G' was added to the 5' end of the primer since it has been established that the human U6 promoter prefers a 'G' at the transcription start site (see Cong, L. et al., Multiplex genome engineering using CRISPR/Cas systems. Science 339, 819-823, doi:10.1126/science.1231143 (2013)). The pFYF sgRNA plasmid described previously was used as a template for PCR amplification.

TABLE 17

Sequences of sgRNAs used for Hek293T
mammalian cell transfection.

| Site | RNAspacer sequence | SEQ ID NO: | Cas9 scaffold | PAM |
|---|---|---|---|---|
| 1 | GAACACAAAGCAUAGACUGC | 811 | *S. pyogenes* | NGG |
| 2 | GGGAAAGACCCAGCAUCCGU | 812 | *S. pyogenes* | NGG |
| 3 | GCUCCCAUCACAUCAACCGG | 813 | *S. pyogenes* | NGG |
| 4 | GGUGAGUGAGUGUGUGCGUG | 814 | *S. pyogenes* | NGG |
| 5 | GGCUUCAGGUUCUAAAUGAG | 815 | *S. pyogenes* | NGG |
| 6 | GCAGAGAGUCGCCGUCUCCA | 816 | *S. pyogenes* | NGG |
| 7 | GUGUAAGACCUCAAAAGCAC | 817 | *S. pyogenes* | NGG |
| 8 | GAUGAGAAGGAGAAGUUCUU | 818 | *S. pyogenes* | NGG |
| 9 | GAGGACAAAGUACAAACGGC | 819 | *S. pyogenes* | AGA |
| 10 | GCCACCACAGGGAAGCUGGG | 820 | *S. pyogenes* | TGA |
| 11 | GCUCUCAGGCCCUGUCCGCA | 821 | *S. pyogenes* | CGT |
| 12 | GAGCAAAUACCAGAGAUAAG | 822 | *S. pyogenes* | AGA |
| 13 | GAUCAGGAAAUAGAGCCACA | 823 | *S. pyogenes* | GGC |
| 14 | GCCCAUCCCUGAGUCCAGCG | 824 | *S. pyogenes* | AGC |
| 15 | GAACACGAAGACAUCUGAAGGUA | 825 | *S. aureus* | TTGAAT |
| 16 | GAUUUACAGCCUGGCCUUUGGGG | 826 | *S. aureus* | TCGGGT |
| 17 | GGAGAGAAAGAGAAGUUGAUUG | 827 | *S. aureus* | ATGGGT |
| 18 | GAGGGUGAGGGAUGAGAUAAUG | 828 | *S. aureus* | ATGAGT |
| 19 | GGUGGAGGAGGGUGCAUGGGGU | 829 | *S. aureus* | CAGAAT |
| 20 | GCUGUUGCAUGAGGAAAGGGAC | 830 | *S. aureus* | TAGAGT |
| HEK2 | GAACACAAAGCAUAGACUGC | 811 | *S. pyogenes* | CGG |
| HEK3 | GGCCCAGACUGAGCACGUGA | 831 | *S. pyogenes* | TGG |
| HEK4 | GGCACUGCGGCUGGAGGUGG | 832 | *S. pyogenes* | GGG |
| LDLR | GCAGAGCACUGGAAUUCGUCA | 833 | *S. pyogenes* | GGG | sgRNA scaffold sequences are as follows:

*S. pyogenes*:

(SEQ ID NO: 834)
GUUUUAGAGCUAGAAAUAGCAAGUUAAAAUAAGGCUAGUCCGUUAUCAACU

UGAAAAAGUGGCACCGAGUCGGUGC

*S. aureus*:

(SEQ ID NO: 835)
GUUUUAGUACUCUGUAAUGAAAAUUACAGAAUCUACUAAAACAAGGCAAAA

UGCCGUGUUUAUCUCGUCAACUUGUUGGCGAGA

Generation of input bacterial TadA* libraries for directed evolution The TadA*8.0 library was designed to encode all 20 amino acids at each amino acid position in the TadA*7.10 open reading frame (Gaudelli, N. M. et al., Programmable base editing of A*T to G*C in genomic DNA without DNA cleavage. Nature 551, 464-471, doi:10.1038/nature24644 (2017)). Each TadA*8.0 library member contained about 1-2 new coding mutations and was chemically synthesized and purchased from Ranomics Inc (Toronto, Canada). The TadA*8.0 library was PCR amplified with Phusion U Green MultiPlex PCR Master Mix and USER-assembled into a bacterial vector optimized for ABE directed evolution (Gaudelli, N. M. et al., Programmable base editing of A*T to G*C in genomic DNA without DNA cleavage. Nature 551, 464-471, doi:10.1038/nature24644 (2017)).

Bacterial Evolution of TadA Variants

Directed evolution of ABE containing the TadA*8 library was conducted as previously described (Gaudelli, N. M. et al., Programmable base editing of A*T to G*C in genomic DNA without DNA cleavage. Nature 551, 464-471, doi: 10.1038/nature24644 (2017)) with the following changes: i) E. coli 10 betas (New England Biolabs) were used as the evolution host; and ii) survival on kanamycin relied on correction of three genetic inactivating components (e.g. survival required reversion of two stop mutations and one active site mutation in kanamycin). The kanamycin resistance gene sequence (below) contains selection mutations for ABE8 evolution. After overnight co-culturing of selection plasmid and editor in 10 beta host cells, the library cultures were plated on 2xYT-agar medium supplemented with plasmid maintenance antibiotic and increasing concentrations of selection antibiotic, kanamycin (64-512 µg/mL). Bacteria were allowed to grow for 1 day and the TadA*8 portion of the surviving clones were Sanger sequenced after enrichment. Identified TadA*8 mutations of interest were then incorporated into mammalian expression vector via USER assembly.

In the following sequence, lower case denotes the kanamycin resistance promoter region, bold sequence indicates targeted inactivation portion (Q4* and W15*), the italicized sequence denotes the targeted inactive site of kanamycin resistance gene (D208N), and the underlined sequences denote the PAM sequences.

Inactivated Kanamycin Resistance Gene:

(SEQ ID NO: 836)
ccggaattgccagctggggcgccctctggtaaggttgggaagccctgcaaa gtaaactggatggctttcttgccgccaaggatctgatggcgcaggggatca agatctgatcaagagacaggatgaggat<u>cctttcgc</u>ATGATCGAATAAGAT

GGATTGCACGCAGGTTCTCCGGCCGCTTAGGTGGAGCGCCTATT<u>CGGCTAT</u>

GACTGGGCACAACAGACAATCGGCTGCTCTGATGCCGCCGTGTTCCGGCTG

TCAGCGCAGGGGCGCCCGGTTCTTTTTGTCAAGACCGACCTGTCCGGTGCC

CTGAATGAACTGCAGGACGAGGCAGCGCGGCTATCGTGGCTGGCCACGACG

GGCGTTCCTTGCGCAGCTGTGCTCGACGTTGTCACTGAAGCGGGAAGGGAC

TGGCTGCTATTGGGCGAAGTGCCGGGGCAGGATCTCCTGTCATCTCACCTT

GCTCCTGCCGAGAAAGTATCCATCATGGCTGATGCAATGCGGCGGCTGCAT

ACGCTTGATCCGGCTACCTGCCCATTCGACCACCAAGCGAAACATCGCATC

GAGCGAGCACGTACTCGGATGGAAGCCGGTCTTGTCGATCAGGATGATCTG

GACGAAGAGCATCAGGGGCTCGCGCCAGCCGAACTGTTCGCCAGGCTCAAG

GCGCGCATGCCCGACGGCGAGGATCTCGTCGTGACCCATGGCGATGCCTGC

TTGCCGAATATCATGGTGGAAAATGGCCGCTTTTCTGGA*TTCATTAACTGT*

*GGCCGGCT*<u>GGG</u>TGTGGCGGACCGCTATCAGGACATAGCGTTGGCTACCCGT

GATATTGCTGAAGAGCTTGGCGGCGAATGGGCTGACCGCTTCCTCGTGCTT

-continued
```
TACGGTATCGCCGCTCCCGATTCGCAGCGCATCGCCTTCTATCGCCTTCTT

GACGAGTTCTTCTAA
```

General HEK293T and RPMI-8226 Mammalian Culture Conditions

Cells were cultured at 37° C. with 5% $CO_2$. HEK293T cells [CLBTx013, American Type Cell Culture Collection (ATCC)]were cultured in Dulbecco's modified Eagles medium plus Glutamax (10566-016, Thermo Fisher Scientific) with 10% (v/v) fetal bovine serum (A31606-02, Thermo Fisher Scientific). RPMI-8226 (CCL-155, ATCC) cells were cultured in RPMI-1640 medium (Gibco) with 10% (v/v) fetal bovine serum (Gibco). Cells were tested negative for *mycoplasma* after receipt from supplier.

Hek293T Plasmid Transfection and gDNA Extraction

HEK293T cells were seeded onto 48-well well Poly-D-Lysine treated BioCoat plates (Corning) at a density of 35,000 cells/well and transfected 18-24 hours after plating. Cells were counted using a NucleoCounter NC-200 (Chemometec). To these cells were added 750 ng of base editor or nuclease control, 250 ng of sgRNA, and 10 ng of GFP-max plasmid (Lonza) diluted to 12.5 µL total volume in Opti-MEM reduced serum media (ThermoFisher Scientific). The solution was combined with 1.5 µL of Lipofectamine 2000 (ThermoFisher) in 11 µL of Opti-MEM reduced serum media and left to rest at room temperature for 15 min.

The entire 25 µL mixture was then transferred to the pre-seeded Hek293T cells and left to incubate for about 120 h. Following incubation, media was aspirated and cells were washed two times with 250 µL of 1x PBS solution (ThermoFisher Scientific) and 100 µL of freshly prepared lysis buffer was added (100 mM Tris-HCl, pH 7.0, 0.05% SDS, 25 µg/mL Proteinase K (Thermo Fisher Scientific). Transfection plates containing lysis buffer were incubated at 37° C. for 1 hour and the mixture was transferred to a 96-well PCR plate and heated at 80° C. for 30 min.

Figures 9A, 9B:
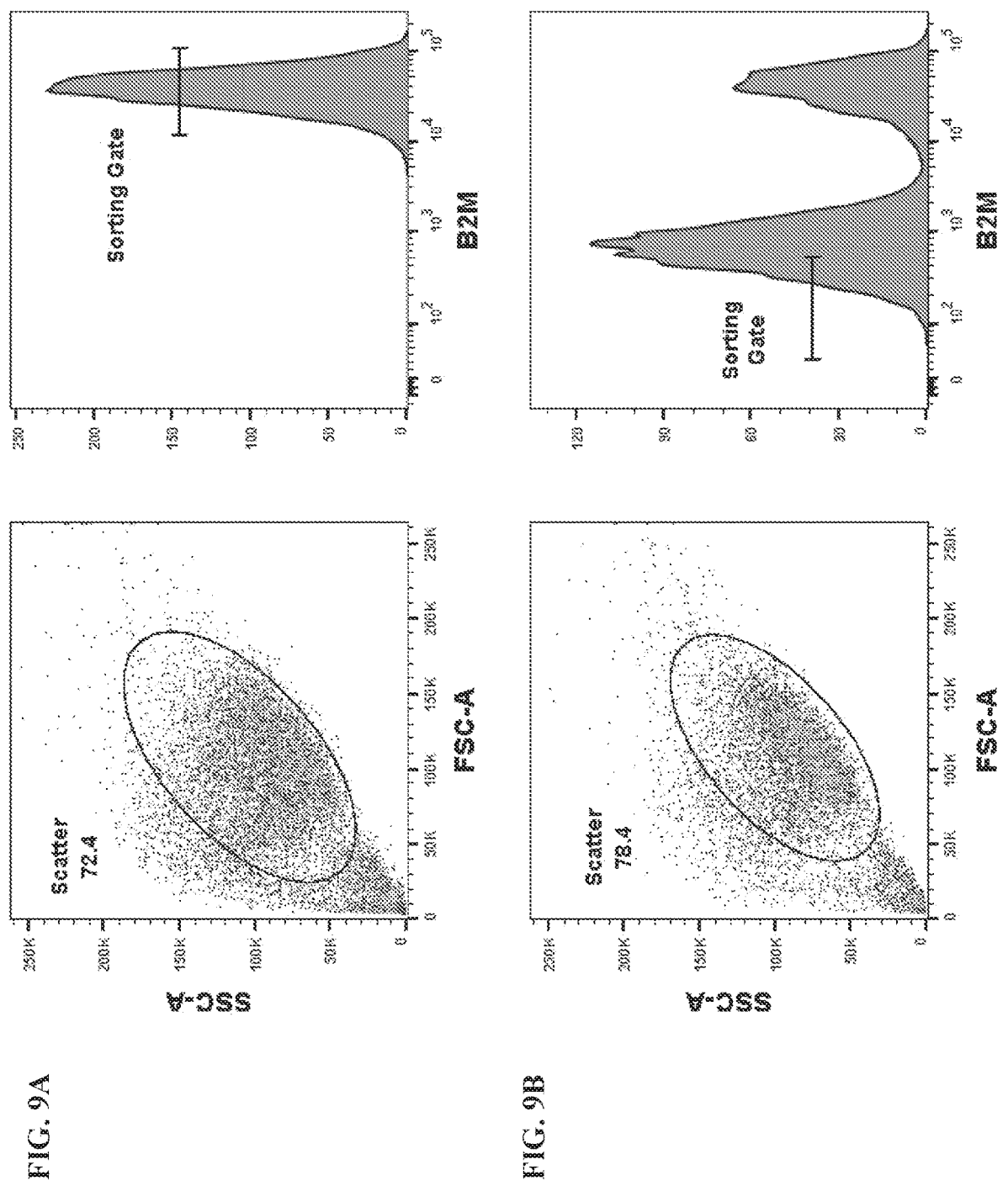
FIGS. 9A and 9B depict representative examples of gates used to flow sort B2M-positive and B2M-negative cells prior to whole genome sequencing.

Treatment of HEK293T Cells for Whole Genome Sequencing, Including Preparation of Genomic DNA and Clonal Isolation of Edited Cells Cells were lipofected with base editor or Cas9-encoding mRNA combined an sgRNA targeting a region in B2M, which, when successfully targeted by ABE, CBE or Cas9 leads to disruption of B2M (sgRNA target sequence: 5'-CT-TACCCCACTTAACTATCT-3' (SEQ ID NO: 506), Synthego) (Qasim, W. et al. Molecular remission of infant B-ALL after infusion of universal TALEN gene-edited CAR T cells. Sci Transl Med 9, doi:10.1126/scitranslmed.aaj2013 (2017)) either through splice site disruption (ABE, Cas9) or incorporation of a stop codon (CBE), as described herein. 24 hours post-transfection, cells were split 3:8 into a new plate to encourage cell growth. Three days post-transfection, HEK293T cells were harvested with TryplE Express (ThermoFisher), washed 1X with FACS buffer (PBS, 1% BSA, both ThermoFisher) and chilled at 4° C. for 15 minutes. The cells were then pelleted (1500 *g, 5 mins) and resuspended in a solution of FACS buffer with a 1:100 dilution of PE anti-human B2-microglobin (Biolegend 316306). Cells were incubated for 30 mins in the dark at 4° C. Cells were then washed 3 times with FACS buffer by centrifugation (1500 *g, 5 mins) and resuspended in FACS buffer. Single, B2M-negative cells were sorted into 96-well plates except from untreated cells for which B2M-positive cells were sorted into 96-well plates. Representative FACS plots are shown in FIGS. 9A and 9B. Nine days post sorting, wells were inspected and those containing single colonies were marked and treated with TryplE Express to promote cell growth. After four days of additional growth, genomic DNA was harvested from cells using Agincourt DNAdvance kit (Beckmann Coulter), according to the manufacturer's instructions.

Genomic DNA was fragmented and adapter-ligated using the Nextera DNA Flex Library Prep Kit (Illumina) using the 96-well plate Nextera indexing primers (Illumina), according to the manufacturer's instructions. Library size and concentration was confirmed by Fragment Analyzer (Agilent) and sent to Novogene for whole genome sequencing using an Illumina HiSeq.

Analysis of Whole Transcriptome and Whole Genome Sequencing Data

All targeted NGS data were analyzed by performing four general steps: (1) alignment, (2) duplicate marking, (3) variant calling (4) background filtration of variants to remove artifacts and germline mutations. Each step is described below. The mutation reference and alternate alleles are reported relative to the plus strand of the reference genome.

Whole Transcriptome Analysis Details

1. Lane level FASTQ files were separately aligned to the human genome (Gencode GRCh38v31 primary assembly) using STAR (v2.7.2a) with parameters set to specify the ReadGroup and output both a genome aligned BAM file and a transcriptome aligned BAM file.

2. Lane level genome alignments for each sample created in step (1) were merged, sorted by coordinate, and duplicate marked using Picard (v2.20.5).

3. Reads containing Ns in their cigar string because they span splicing junctions were split using GATK (v4.1.3.0) SplitNCigarReads.

4. Base quality scores were recalibrated using Picard with default settings.

5. Variants were called using GATK HaplotypeCaller. Only reads with a mapping quality ≥30 were considered and the minimum base quality (Phred score) for counting a non-reference base was set to 20. Standard settings for variant calling in RNA-seq were used: minimum-base-quality=20, minimum-mapping-quality=30, don't-use-soft-clipped-bases, standard-call-conf=20.

6. Mutations private to base-editor treated samples were identified using background filtration. The highest coverage 'No Treatment' sample was used as the background sample. Only substitutions on canonical chromosomes were considered. Mutations were considered private to the base-editor treated sample if they met the following criteria:

a. The genomic position of the mutation had coverage ≥30 reads in the treated sample and ≥20 reads in the untreated sample b. The untreated sample had ≥99% of reads supporting the reference, non-mutant, base at the position of the mutation c. The variant allele frequency of the mutation in the treated sample was ≥20%.

Whole Genome Sequencing Analysis Details

1. Lane level FASTQ files were separately aligned to the human genome (Gencode GRCh38v31 primary assembly) using BWA (0.7.17-r1188) mem with parameters set to specify the ReadGroup. The -M flag was also set to mark shorted split hits a secondary alignments.

2. Lane level genome alignments for each sample created in step (1) were merged, sorted by coordinate, and duplicate marked using Picard (v2.20.5) using default settings.

3. Variants were called using GATK (v4.1.3.0) HaplotypeCaller. Only reads with a mapping quality ≥30 were considered and the minimum base quality (Phred score) for counting a non-reference base was set to 20. Standard settings for variant calling in DNA-seq were used.

4. Mutations private to base-editor treated samples were identified using background filtration. The highest coverage 'No Treatment' sample was used as the background sample. Only substitutions on canonical chromosomes were considered. Mutations were considered private to the base-editor treated sample if they met the following criteria:

a. The genomic position of the mutation had coverage $\geq 10$ reads in the treated and untreated sample b. The untreated sample had $\geq 99\%$ of reads supporting the reference, non-mutant, base at the position of the mutation Analysis of DNA and RNA Off-Target Editing for ABE Architecture and ABE8 Constructs HEK293T cells were plated on 48-well poly-D-lysine coated plates (Corning) 16 to 20 hours before lipofection at a density of 30,000 cells per well in DMEM+Glutamax medium (Thermo Fisher Scientific) without antibiotics. 750 ng nickase or base editor expression plasmid DNA was combined with 250 ng of sgRNA expression plasmid DNA in 15 µl OPTIMEM+Glutamax. This was combined with 10 µl of lipid mixture, comprising 1.5 µl Lipofectamine 2000 and 8.5 µl OPTIMEM+Glutamax per well. Cells were harvested 3 days after transfection and either DNA or RNA was harvested. For DNA analysis, cells were washed once in 1×PBS, and then lysed in 100 µl QuickExtract™ Buffer (Lucigen) according to the manufacturer's instructions. For RNA harvest, the MagMAX™ mirVana™ Total RNA Isolation Kit (Thermo Fisher Scientific) was used with the KingFisher™ Flex Purification System according to the manufacturer's instructions.

Figure 5A:
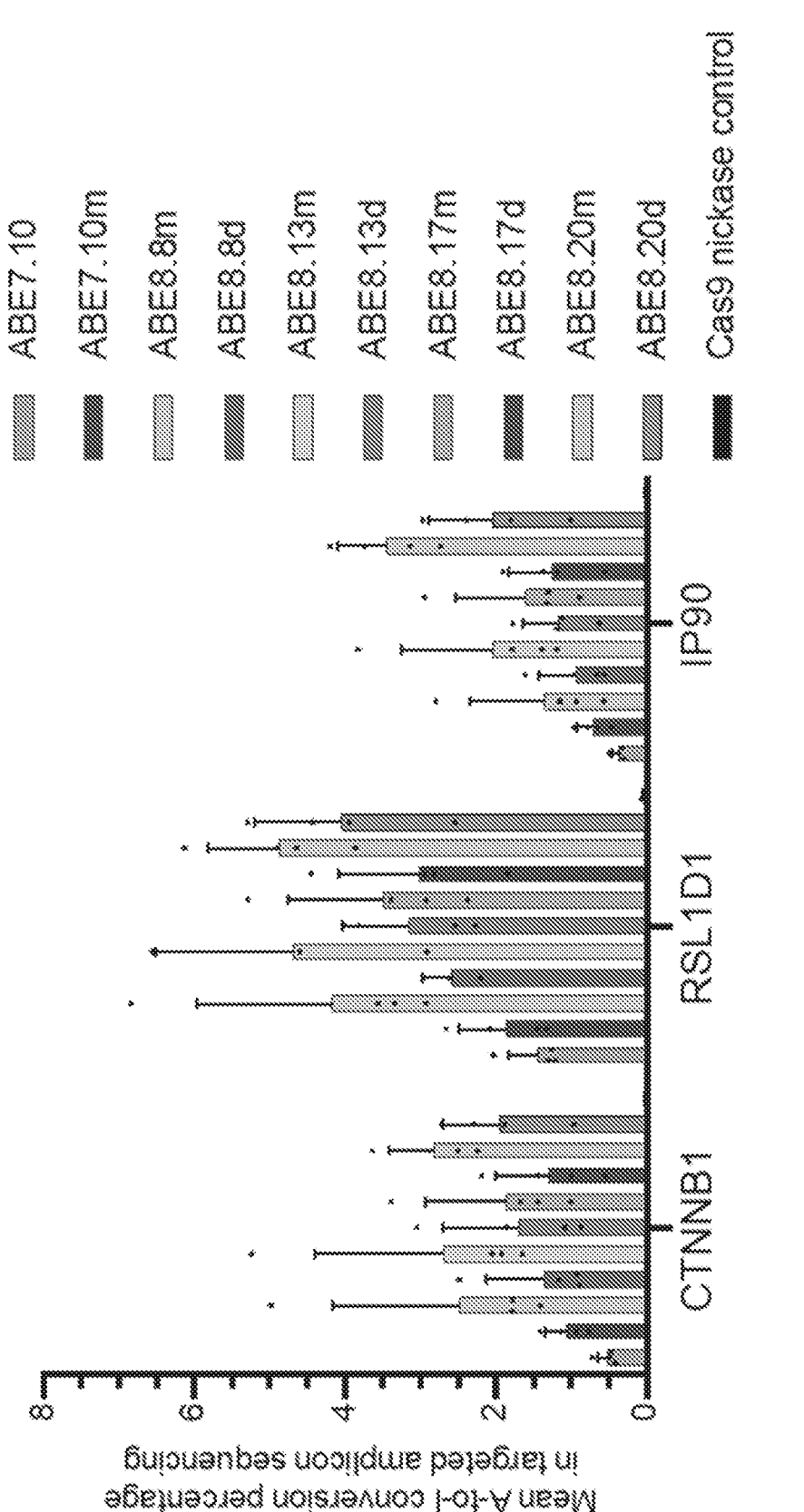
FIGS. 5A and 5B depict RNA amplicon sequencing to detect cellular A-to-I editing in RNA associated with ABE treatment. Individual data points are shown and error bars represent s.d. for n=3 independent biological replicates, performed on different days.
Figure 5B:
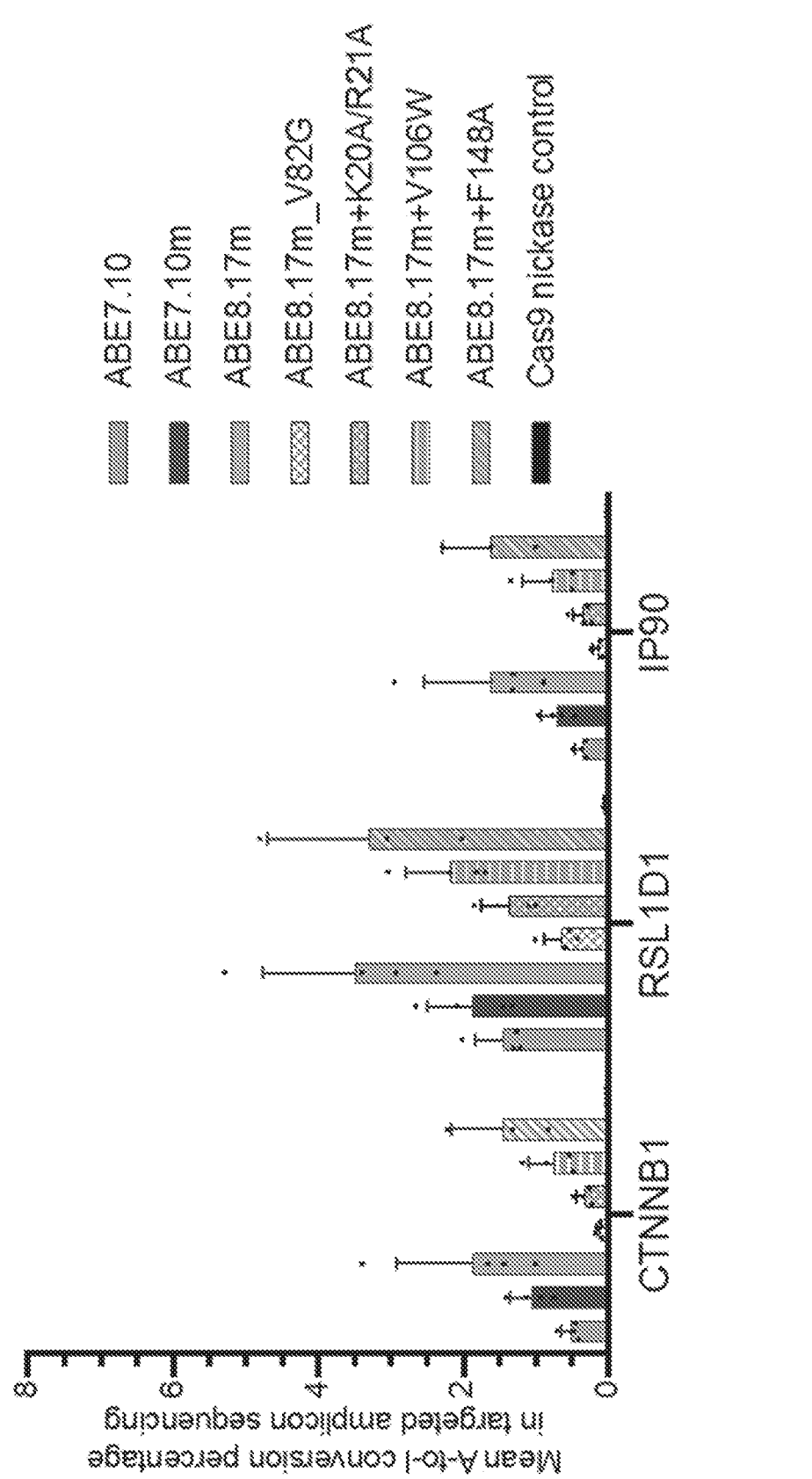

Targeted RNA sequencing was performed (see Rees, H. A. et al., Analysis and minimization of cellular RNA editing by DNA adenine base editors. Sci Adv 5, eaax5717, doi: 10.1126/sciadv.aax5717 (2019)). cDNA was prepared from the isolated RNA using the SuperScript IV One-Step RT-PCR System with EZDnase (Thermo Fisher Scientific) according to the manufacturer's instructions. The following program was used: 58° C. for 12 min; 98° C. for 2 min; followed by PCR cycles which varied by amplicon: for CTNNB1 and IP90: 32 cycles of [98° C. for 10 sec; 60° C. for 10 sec; 72° C. for 30 sec]and for RSL1D1 35 cycles of [98° C. for 10 sec; 58° C. for 10 sec; 72° C. for 30 sec]. No RT controls were run concurrently with the samples. Following the combined RT-PCR, amplicons were barcoded and sequenced using an Illumina Miseq. The first 125nt in each amplicon, beginning at the first base after the end of the forward primer in each amplicon, was aligned to a reference sequence and used for analysis of mean and maximum A-to-I frequencies in each amplicon (FIGS. 5A and 5B).

Off-target DNA sequencing was performed using the primers listed in Table 18 below using a two-step PCR and barcoding method to prepare samples for sequencing using Illumina Miseq sequencers as above (see Komor, A. C. et al., Programmable editing of a target base in genomic DNA without double-stranded DNA cleavage. Nature 533, 420-424, doi:10.1038/nature17946 (2016); Rees, H. A. et al., Analysis and minimization of cellular RNA editing by DNA adenine base editors. Sci Adv 5, eaax5717, doi: 10.1126/sciadv.aax5717 (2019)).

TABLE 18

| HTS Primers used to amplify genomic sites | | |
|---|---|---|
| Primer Name | Sequence | SEQ ID NO: |
| fwd_site_1 | ACACTCTTTCCCTACACGACGCTCTTCCGATCTNNNNCCAGCCCCATCTG TCAAACT | 837 |
| rev_site_1 | TGGAGTTCAGACGTGTGCTCTTCCGATCTTGAATGGATTCCTTGGAAACA ATGA | 838 |
| fwd_site_2 | ACACTCTTTCCCTACACGACGCTCTTCCGATCTNNNNNTGAGGGAGAGCCG TGTAGTT | 839 |
| rev_site_2 | TGGAGTTCAGACGTGTGCTCTTCCGATCTGCCTCTCAAAGTGCTGGGAT | 840 |
| fwd_site_3 | ACACTCTTTCCCTACACGACGCTCTTCCGATCTNNNNCCATCAGGCTCTC AGCTCAG | 841 |
| rev_site_3 | TGGAGTTCAGACGTGTGCTCTTCCGATCTCTCGTGGGTTTGTGGTTGC | 842 |
| fwd_site_4 | ACACTCTTTCCCTACACGACGCTCTTCCGATCTNNNNGCCCATTCCCTCT TTAGCCA | 843 |
| rev_site_4 | TGGAGTTCAGACGTGTGCTCTTCCGATCTGAGCCGTTCCCTCTTTGCTA | 844 |
| fwd_site_5 | ACACTCTTTCCCTACACGACGCTCTTCCGATCTNNNNAACCTGTGTGACA CTTGGCA | 845 |
| rev_site_5 | TGGAGTTCAGACGTGTGCTCTTCCGATCTGTCTGGCCCAAGATCACACA | 846 |
| fwd_site_6 | ACACTCTTTCCCTACACGACGCTCTTCCGATCTNNNCACGGATAAAGACG CTGGGA | 847 |
| rev_site_6 | TGGAGTTCAGACGTGTGCTCTTCCGATCTGGGGTCCCAGGTGCTGAC | 848 |
| fwd_site_7 | ACACTCTTTCCCTACACGACGCTCTTCCGATCTNNNTTGATTGTCTCCTT TGCCGC | 849 |

TABLE 18-continued

HTS Primers used to amplify genomic sites

| Primer Name | Sequence | SEQ ID NO: |
|---|---|---|
| rev_site_7 | TGGAGTTCAGACGTGTGCTCTTCCGATCTTGACCCAGTGTTTGATAGATCAGT | 850 |
| fwd_site_8 | ACACTCTTTCCCTACACGACGCTCTTCCGATCTNNNCACCCCTTCAGTCCATGCTT | 851 |
| rev_site_8 | TGGAGTTCAGACGTGTGCTCTTCCGATCTTCTGATGGGGAGGAACGAGT | 852 |
| fwd_site_9 | ACACTCTTTCCCTACACGACGCTCTTCCGATCTNNNNCAGCTCAGCCTGAGTGTTGA | 853 |
| rev_site_9 | TGGAGTTCAGACGTGTGCTCTTCCGATCTGCCCACCCTAGTCATTGGAG | 854 |
| fwd_site_10 | ACACTCTTTCCCTACACGACGCTCTTCCGATCTNNNNGTCAGAGGGACACACTGTGG | 855 |
| rev_site_10 | TGGAGTTCAGACGTGTGCTCTTCCGATCTCACACTCACTCACCCACACA | 856 |
| fwd_site_11 | ACACTCTTTCCCTACACGACGCTCTTCCGATCTNNNNTGTGTGGGTGAGTGAGTGTG | 857 |
| rev_site_11 | TGGAGTTCAGACGTGTGCTCTTCCGATCTCACCAAGGTTCACAGCCTGA | 858 |
| fwd_site_12 | ACACTCTTTCCCTACACGACGCTCTTCCGATCTNNNNTTGTCTCTGCCTGTAGCTGC | 859 |
| rev_site_12 | TGGAGTTCAGACGTGTGCTCTTCCGATCTCGCTCTGGGCTTCATCTTCA | 860 |
| fwd_site_13 | ACACTCTTTCCCTACACGACGCTCTTCCGATCTNNNNTGGGATTATGGGTGTGAGCC | 861 |
| rev_site_13 | TGGAGTTCAGACGTGTGCTCTTCCGATCTTGCCTTCCTCCTCTCTCTCC | 862 |
| fwd_site_14 | ACACTCTTTCCCTACACGACGCTCTTCCGATCTNNNNTGCAGACCAGATTCGGAGAA | 863 |
| rev_site_14 | TGGAGTTCAGACGTGTGCTCTTCCGATCTGTTCAGTTTCCAGGGGGTCC | 864 |
| fwd_site_15 | ACACTCTTTCCCTACACGACGCTCTTCCGATCTNNNNTCCGCACAGCCTTAGTTCAA | 865 |
| rev_site_15 | TGGAGTTCAGACGTGTGCTCTTCCGATCTAACTTGAAGAGACGGCAGCA | 866 |
| fwd_site_16 | ACACTCTTTCCCTACACGACGCTCTTCCGATCTNNNNCCCCCAGCTACAGAAAGGTC | 867 |
| rev_site_16 | TGGAGTTCAGACGTGTGCTCTTCCGATCTATTTCCACCGCAAAATGGCC | 868 |
| fwd_site_17 | ACACTCTTTCCCTACACGACGCTCTTCCGATCTNNNNTCACTTCAGCCCAGGAGTAT | 869 |
| rev_site_17 | TGGAGTTCAGACGTGTGCTCTTCCGATCTTGTGTATGGTGAGAGGTAGGGA | 870 |
| fwd_site_18 | ACACTCTTTCCCTACACGACGCTCTTCCGATCTNNNNGTCTGAGGTCACACAGTGGG | 871 |
| rev_site_18 | TGGAGTTCAGACGTGTGCTCTTCCGATCTCTGAGAGCAGGGACCACATC | 872 |
| fwd_site_19 | ACACTCTTTCCCTACACGACGCTCTTCCGATCTNNNNGGGGAGGTGGAGAGAGGATGT | 873 |
| rev_site_19 | TGGAGTTCAGACGTGTGCTCTTCCGATCTACTCTTCCTGAGGTCTAGGAACCCG | 874 |
| fwd_site_20 | ACACTCTTTCCCTACACGACGCTCTTCCGATCTNNNNCCCTGTTCCTAAAGCCCACC | 875 |
| rev_site_20 | TGGAGTTCAGACGTGTGCTCTTCCGATCTACTCTCTGGTTCTGTTTGTGGCCA | 876 |
| fwd_CTNNB1 | ACACTCTTTCCCTACACGACGCTCTTCCGATCTNNNNATTTGATGGAGTTGGACATGGCC | 877 |

TABLE 18-continued

HTS Primers used to amplify genomic sites

| Primer Name | Sequence | SEQ ID NO: |
|---|---|---|
| rev_CTNNB1 | TGGAGTTCAGACGTGTGCTCTCCAGCTACTTGTTCTTGAGTGAAGG | 878 |
| fwd_RSL1D1 | ACACTCTTTCCCTACACGACGCTCTTCCGATCTNNNNTGGCTTTCCAAATCAGTGGGTC | 879 |
| rev_RSL1D1 | TGGAGTTCAGACGTGTGCTCTTCCGATCTCTCATAAGCTTAGACCAACAAGC | 880 |
| fwd_IP90 | ACACTCTTTCCCTACACGACGCTCTTCCGATCTNNNNCTGGTTGACCAATCTGTGGTG | 881 |
| rev_IP90 | TGGAGTTCAGACGTGTGCTCTCTGCGTCTGGATCAGGTACG | 882 |
| fwd_HEK293_site2_off1 | ACACTCTTTCCCTACACGACGCTCTTCCGATCTNNNNGTGTGGAGAGTGAGTAAGCCA | 883 |
| rev_HEK293_site2_off1 | TGGAGTTCAGACGTGTGCTCTTCCGATCTACGGTAGGATGATTTCAGGCA | 884 |
| fwd_HEK293_site2_off2 | ACACTCTTTCCCTACACGACGCTCTTCCGATCTNNNNCACAAAGCAGTGTAGCTCAGG | 885 |
| rev_HEK293_site2_off2 | TGGAGTTCAGACGTGTGCTCTTCCGATCTTTTTTGGTACTCGAGTGTTATTCAG | 886 |
| fwd_HEK293_site3_off1 | ACACTCTTTCCCTACACGACGCTCTTCCGATCTNNNNTCCCCTGTTGACCTGGAGAA | 887 |
| rev_HEK293_site3_off1 | TGGAGTTCAGACGTGTGCTCTTCCGATCTCACTGTACTTGCCCTGACCA | 888 |
| fwd_HEK293_site3_off2 | ACACTCTTTCCCTACACGACGCTCTTCCGATCTNNNNTTGGTGTTGACAGGGAGCAA | 889 |
| rev_HEK293_site3_off2 | TGGAGTTCAGACGTGTGCTCTTCCGATCTCTGAGATGTGGGCAGAAGGG | 890 |
| fwd_HEK293_site3_off3 | ACACTCTTTCCCTACACGACGCTCTTCCGATCTNNNNTGAGAGGGAACAGAAGGGCT | 891 |
| rev_HEK293_site3_off3 | TGGAGTTCAGACGTGTGCTCTTCCGATCTGTCCAAAGGCCCAAGAACCT | 892 |
| fwd_HEK293_site3_off4 | ACACTCTTTCCCTACACGACGCTCTTCCGATCTNNNNTCCTAGCACTTTGGAAGGTCG | 893 |
| rev_HEK293_site3_off4 | TGGAGTTCAGACGTGTGCTCTTCCGATCTGCTCATCTTAATCTGCTCAGCC | 894 |
| fwd_HEK293_site3_off5 | ACACTCTTTCCCTACACGACGCTCTTCCGATCTNNNNAAAGGAGCAGCTCTTCCTGG | 895 |
| rev-HEK293_site3_off5 | TGGAGTTCAGACGTGTGCTCTTCCGATCTGTCTGCACCATCTCCCACAA | 896 |
| fwd_HEK293_site4_off1 | ACACTCTTTCCCTACACGACGCTCTTCCGATCTNNNNGGCATGGCTTCTGAGACTCA | 897 |
| rev_HEK293_site4_off1 | TGGAGTTCAGACGTGTGCTCTTCCGATCTGTCTCCCTTGCACTCCCTGTCTTT | 898 |
| fwd_HEK293_site4_off2 | ACACTCTTTCCCTACACGACGCTCTTCCGATCTNNNNTTTGGCAATGGAGGCATTGG | 899 |
| rev_HEK293_site4_off2 | TGGAGTTCAGACGTGTGCTCTTCCGATCTGAAGAGGCTGCCCATGAGAG | 900 |
| fwd_HEK293_site4_off3 | ACACTCTTTCCCTACACGACGCTCTTCCGATCTNNNNGGTCTGAGGCTCGAATCCTG | 901 |
| rev_HEK293_site4_off3 | TGGAGTTCAGACGTGTGCTCTTCCGATCTCTGTGGCCTCCATATCCCTG | 902 |
| fwd_HEK293_site4_off4 | ACACTCTTTCCCTACACGACGCTCTTCCGATCTNNNNTTTCCACCAGAACTCAGCCC | 903 |
| rev_HEK293_site4_off4 | TGGAGTTCAGACGTGTGCTCTTCCGATCTCCTCGGTTCCTCCACAACAC | 904 |
| fwd_HEK293_site4_off5 | ACACTCTTTCCCTACACGACGCTCTTCCGATCTNNNNCACGGGAAGGACAGGGAGAAG | 905 |

TABLE 18-continued

HTS Primers used to amplify genomic sites

| Primer Name | Sequence | SEQ ID NO: |
|---|---|---|
| rev_HEK293_site4_off5 | TGGAGTTCAGACGTGTGCTCTTCCGATCTGCAGGGGAGGGATAAAGCAG | 906 |
| fwd_HEK_site_3 | ACACTCTTTCCCTACACGACGCTCTTCCGATCTNNNNGGAAACGCCCATG CAATTAGTC | 907 |
| rev_HEK_site_3 | TGGAGTTCAGACGTGTGCTCTTCCGATCTCTTGTCAACCAGTATCCCGGT G | 908 |
| fwd_HEK_site_2 | ACACTCTTTCCCTACACGACGCTCTTCCGATCTNNNNTGAATGGATTCCT TGGAAACAATG | 909 |
| rev_HEK_site_2 | TGGAGTTCAGACGTGTGCTCTTCCGATCTCCAGCCCCATCTGTCAAACT | 910 |
| fwd_HEK_site_4 | TGGAGTTCAGACGTGTGCTCTTCCGATCTTCCTTTCAACCCGAACGGAG | 911 |
| rev_HEK_site_4 | ACACTCTTTCCCTACACGACGCTCTTCCGATCTNNNNGCTGGTCTTCTTT CCCCTCC | 912 |
| fwd_LDLR | ACACTCTTTCCCTACACGACGCTCTTCCGATCTNNNNGCCCTGCTTCTTT TTCTCTGGT | 913 |
| rev_LDLR | TGGAGTTCAGACGTGTGCTCTTCCGATCTACCATTAACGCAGCCAACTTC A | 914 |
| fwd_TRAC | ACACTCTTTCCCTACACGACGCTCTTCCGATCTCATGAGGTCTATGGACT TCAAGAGCAA | 915 |
| Rev_TRAC | TGGAGTTCAGACGTGTGCTCTTCCGATCTCATCATTGACCAGAGCTCTGG GCAGAA | 916 |
| fwd_CBLB | ACACTCTTTCCCTACACGACGCTCTTCCGATCTGCACTTACCAGCATTAC TTCCTAAACC | 917 |
| Rev_CBLB | TGGAGTTCAGACGTGTGCTCTTCCGATCTATGGGCTCCACTTTTCAGCTC TGTAA | 918 |
| fwd_CD7 | ACACTCTTTCCCTACACGACGCTCTTCCGATCTCAGTTCAGGCACATGTA GGAGGGA | 919 |
| Rev_CD7 | TGGAGTTCAGACGTGTGCTCTTCCGATCTACCGCCTGCAGCTGTCGGACA CTGGCA | 920 |
| fwd_B2M | ACACTCTTTCCCTACACGACGCTCTTCCGATCTAAAAGATGAGTATGCCT GCCGTG | 921 |
| Rev_B2M | TGGAGTTCAGACGTGTGCTCTTCCGATCTCAGATTGTTTATATCAGATGG GATGGG | 922 |
| fwd_CIITA | ACACTCTTTCCCTACACGACGCTCTTCCGATCTATGCAAGTTTGGTCCTG AGCCCTCCC | 923 |
| Rev_CIITA | TGGAGTTCAGACGTGTGCTCTTCCGATCTGATGTGGGTTCCCTGCGCTCT GCA | 924 |
| fwd_PDCD1 | ACACTCTTTCCCTACACGACGCTCTTCCGATCTCCAGGGACTGAGGGTGG AAGGTCC | 925 |
| Rev_PDCD1 | TGGAGTTCAGACGTGTGCTCTTCCGATCTACCTCCGCCTGAGCAGTGGAG AA | 926 | mRNA Production for ABE Editors Used in T Cells and HEK293T Cells

Adenosine base editor mRNA were generated using the following synthesis protocol. Editors were cloned into a plasmid encoding a dT7 promoter followed by a 5'UTR, Kozak sequence, ORF, and 3'UTR. The dT7 promoter carries an inactivating point mutation within the T7 promoter that prevents transcription from circular plasmid. This plasmid templated a PCR reaction (Q5 Hot Start 2X Master Mix), in which the forward primer corrected the SNP within the T7 promoter and the reverse primer appended a 120A tail (SEQ ID NO: 212) to the 3' UTR. The resulting PCR product was purified on a Zymo Research 25 µg DCC column and used as mRNA template in the subsequent in vitro transcription. The NEB HiScribe High-Yield Kit was used as per the instruction manual but with full substitution of N1-methyl-pseudouridine for uridine and co-transcriptional capping with CleanCap AG (Trilink). Reaction cleanup was performed by lithium chloride precipitation. Primers used for amplification can be found in Table 19. The Cas9 mRNA was purchased from Trilink (CleanCap Cas9 mRNA 5moU).

Table 19: Primers Used for ABE8 T7 In Vitro Transcription Reactions

TABLE 19

Primers used for ABE8 T7 in vitro transcription reactions

| Name | Sequence |
| --- | --- |
| fwd_IVT | TCGAGCTCGGTACCTAATACGACTCAC (SEQ ID NO: 927) |
| rev_IVT | TTTTTTTTTTTTTTTTTTTTTTTTTTTTTTTTTTTTTTTTTT TTTTTTTTTTTTTTTTTTTT TTTTTTTTTTTTTTTTTTTTTTTTTTTTTTTTTTTTTTTTTT TTTTTTTTTTTTTTTTTTTT CTTCCTACTCAGGCTTTATTCAAAGACCA (SEQ ID ) NO: 928 |

Generation of Anti-BCMA CAR Lentivirus

An anti-BCMA CAR plasmid was constructed containing an MND promoter, anti-BCMA scFv, CD8a hinge, CD8a transmembrane domain, CD137 and CD3zeta co-stimulatory domains, followed by wPRE. Replication defective, self-inactivating (SIN), third-generation human immunodeficiency virus type 1 (HIV-1)-based LVV encoding the CAR, pseudotyped with the vesicular stomatitis virus-glycoprotein (VSV-G) envelope protein were produced by Flash Therapeutics.

Generation of T Cells

Frozen, bulk PBMCs obtained from healthy donors were thawed and cultured in a T-cell growth media (TCGM) consisting of X-VIVO15 (Lonza) supplemented with 5% human serum, type AB (Valley Biomedical), 2 mM of GlutaMAX (Gibco), 10 mM of HEPES buffer solution (Gibco), and 250 IU/mL of recombinant human interleukin-2 (rhIL-2, CellGenix GmbH). Cells were activated with soluble human anti-CD3 (clone OKT3, Miltenyi Biotec) and human anti-CD28 (clone 15E8, Miltenyi Biotec) and cultured at 37° C. in a 5% $CO_2$ incubator. For CAR-modified T cells, lentiviral transduction took place 24 hr after activation at a MOI of 10 with 0.25 mg/mL of Lenti-Boost™ (Sirion Biotech).

Electroporation of Primary Human T Cells

At either 72 hr or 96 hr post T cell activation, cells were spun down at 500 g for 5 mins. Supernatant was removed and cells were then washed once with DPBS (Gibco) and spun again. DPBS was removed and cells were resuspended in P3 primary cell electroporation buffer (Lonza) at a concentration of 50e6 cells/mL. Two micrograms of ABE8 mRNA and one microgram of 5'/3' end-modified sgRNA (Synthego) were added to 1e6 cells (20 μL), which were then electroporated using a Lonza 4-D Nucleofector with 96-well Shuttle™ add-on (Lonza). Sequences of sgRNA can be found in Table 20 below. Post electroporation, 100 μL of TCGM media was used to quench the reaction, and cells were subsequently transferred to a single well of a G-Rex® 24-well plate (Wilson Wolf) containing 8 mL of pre-warmed TCGM+IL-2. Plates were then placed in an incubator (37° C., 5% $CO_2$) until further analysis.

TABLE 20

Sequences of sgRNAs used for T cell transfections

| Site | RNA protospacer sequence | SEQ ID NO: | Cas9 scaffold | supplier |
| --- | --- | --- | --- | --- |
| 21 | csususACCCCACUUAACUAUCU | 929 | S. pyogenes | Synthego |
| 22 | cscscsUACCUGUCACCAGGACC | 930 | S. pyogenes | Synthego |

TABLE 20-continued

Sequences of sgRNAs used for T cell transfections

| Site | RNA protospacer sequence | SEQ ID NO: | Cas9 scaffold | supplier |
| --- | --- | --- | --- | --- |
| 23 | csascsCUACCUAAGAACCAUCC | 931 | S. pyogenes | Synthego |
| 24 | csascsUCACCUUAGCCUGAGCA | 932 | S. pyogenes | Synthego |
| 25 | csususACCUGGGCUGGGGAAGA | 933 | S. pyogenes | Synthego |
| 26 | asususAUACCUGCCAUGCCGUA | 934 | S. pyogenes | Synthego | a, c, g, u: 2'-O-methyl residues
s: phosphorothioate sgRNA Scaffold Sequences:

S. pyogenes:
(SEQ ID NO: 935)
5'-GUUUUAGAGCUAGAAAUAGCAAGUUAAAAUAAGGCUAGUCCGUUAUCA ACUUGAAAAAGUGGCACCGAGUCGGUGCUsususu-3'

Flow Cytometry

To assess editing efficiency, $1 \times 10^6$ cells were taken from culture five days post electroporation and stained with the following primary anti-human antibodies: Cbl-b (Clone D3C12, Cell Signaling Technologies) followed by AlexaFluor 647 F(ab')2 goat anti rabbit IgG (H+L) (Invitrogen), CD3 (Clone UCHT1, PE, Biolegend) CD7 (Clone CD7-6B7, FITC, Biolegend), HLA-DR (Clone L243, PE Biolegend), B2M (Clone 2M2, PE, Biolegend), CD279 (Clone eBioJ105, PE, Biolegend).

Figure 6A:
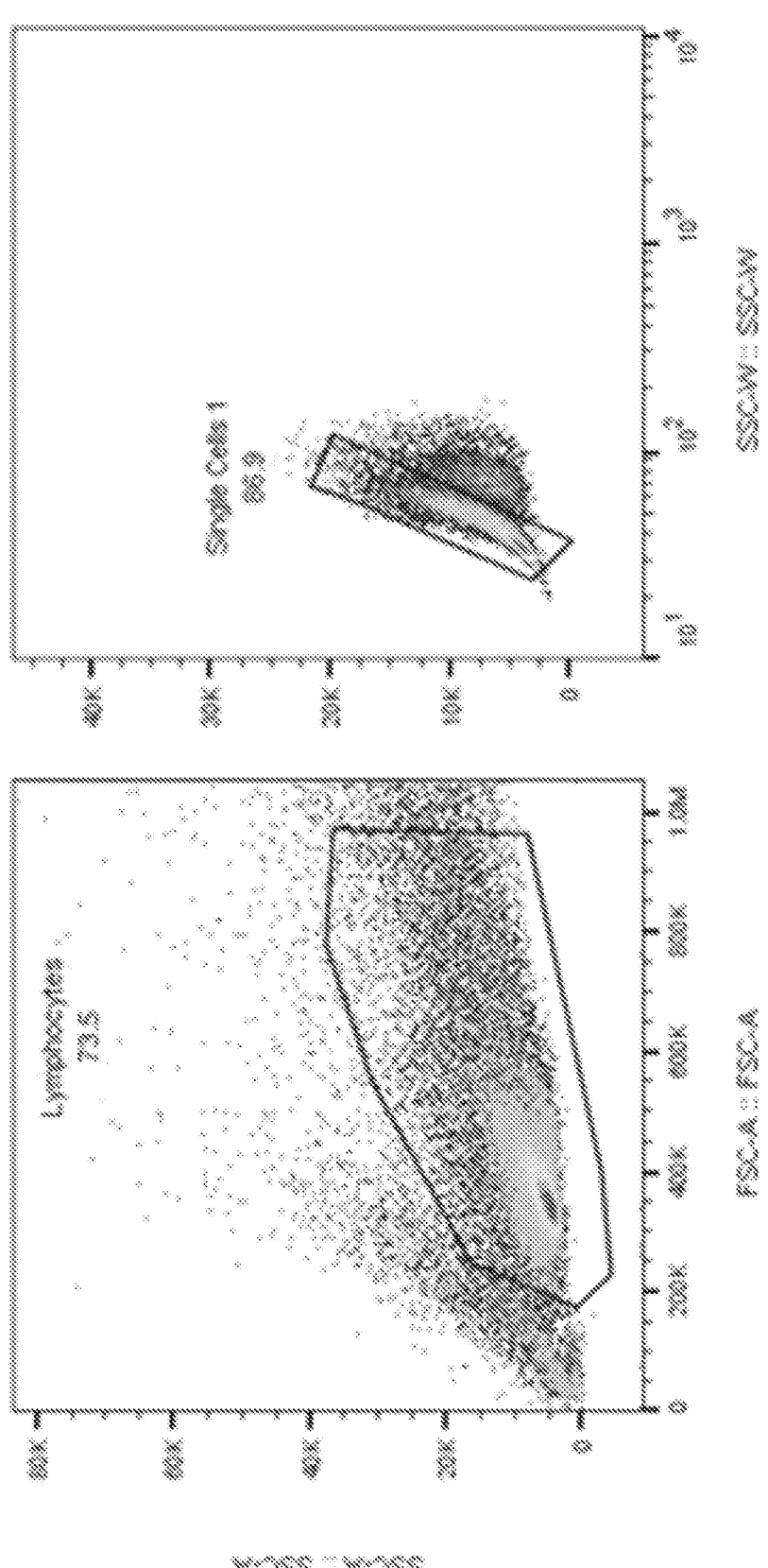
FIGS. 6A and 6B are graphs depicting examples of gates used for assessment of protein knockdown in T cells. Representative gating strategy for population analysis on live, single, lymphocytes in order to determine surface protein reduction via flow cytometry.
Figure 6B:
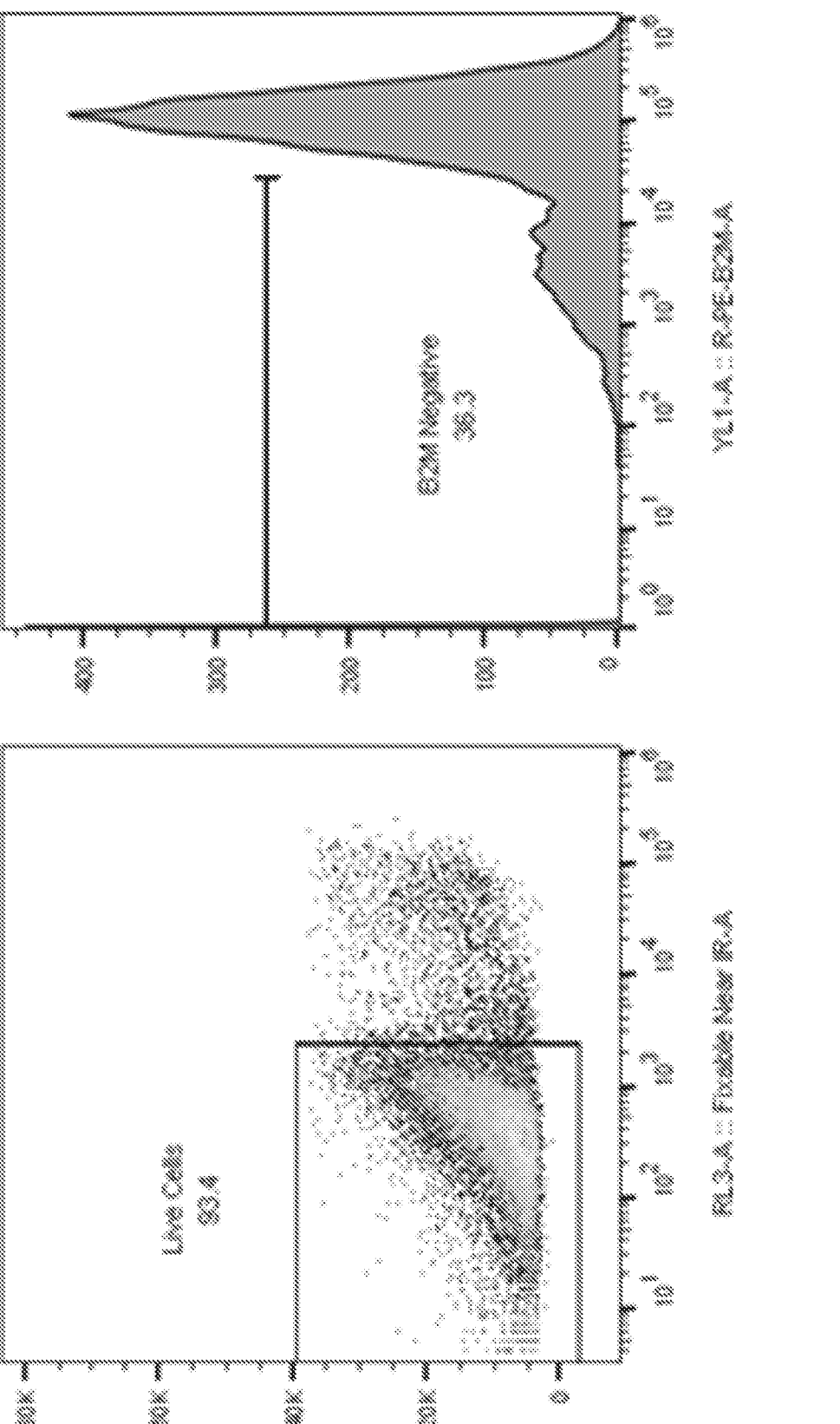

Cell surface detection of CAR molecules utilized a PE-tagged, recombinant TNFRSF17 (BCMA) protein (Creative Biomart). Briefly, $1 \times 10^6$ cells were labelled with LIVE/DEAD@Fixable Near-IR Dead Cell Stain Kit (Molecular Probes) according to manufacturer's instructions. The cells were then incubated with 100 ng of TNFRSF17 recombinant protein for 20 mins at 4° C. and subsequently fixed. Data acquired using an Attune NxT Flow Cytometer and analyzed using FlowJo Single Cell Analysis Software v10.6.1 (FlowJo, LLC). Examples of gating strategies are shown in FIGS. 6A and 6B.

CAR-T Cytotoxicity

RPMI-8226 cells (ATCC), tagged with NucLight Red lentivirus (Sartorius), were plated in 100 μL of RPMI media (Gibco)+10% FBS (Gibco) in a 96 well plate and placed into an Incucyte S3 Live Cell Imaging System (Sartorius) overnight. CAR-modified T cells were placed onto RPMI-8226 cells the following day at an E:T ratio of 1:1. Antigen-dependent killing from the CAR-T cells were measured via reduction of red signal from tagged tumor cells.

Genomic DNA Extraction for Human T-Cells

Following incubation, ~$1 \times 10^6$ of treated T cells were spun down, washed with PBS and resuspended in 200 μL of Quick Extract (Lucigen) lysis buffer and cells were lysed according to the manufacture's protocol. Genomic DNA was directly used in subsequent PCR amplification steps.

Next Generation Sequencing (NGS) of Genomic DNA Samples

Genomic DNA samples were amplified and prepared for high throughput sequencing (see Gaudelli, N. M. et al. Programmable base editing of A*T to G*C in genomic DNA without DNA cleavage. Nature 551, 464-471, doi:10.1038/nature24644 (2017)). Briefly, 1 µL of gDNA was added to a 25 µL PCR reaction containing Phusion U Green Multiplex PCR Master Mix and 0.5 µM of each forward and reverse primer. Following amplification, PCR products were barcoded using unique Illumina barcoding primer pairs. Barcoding reactions contained 0.5 µM of each illumina forward and reverse primer, 2 µL of PCR mixture containing amplified genomic site of interest, and Q5 Hot Start High-Fidelity 2x Master Mix in a total volume of 25 µL. All PCR conditions were carried out as previously published (see Gaudelli, N. M. et al. Programmable base editing of A*T to G*C in genomic DNA without DNA cleavage. Nature 551, 464-471, doi:10.1038/nature24644 (2017)). Primers used for site-specific mammalian cell genomic DNA amplification are listed in Table 18. DNA concentration was quantified using a NanoDrop 1000 Spectrophotometer (ThermoFisher Scientific) and sequence on an Illumina MiSeq Instrument according to the manufacturer's protocols.

Targeted NGS Data Analysis

Figure 7:
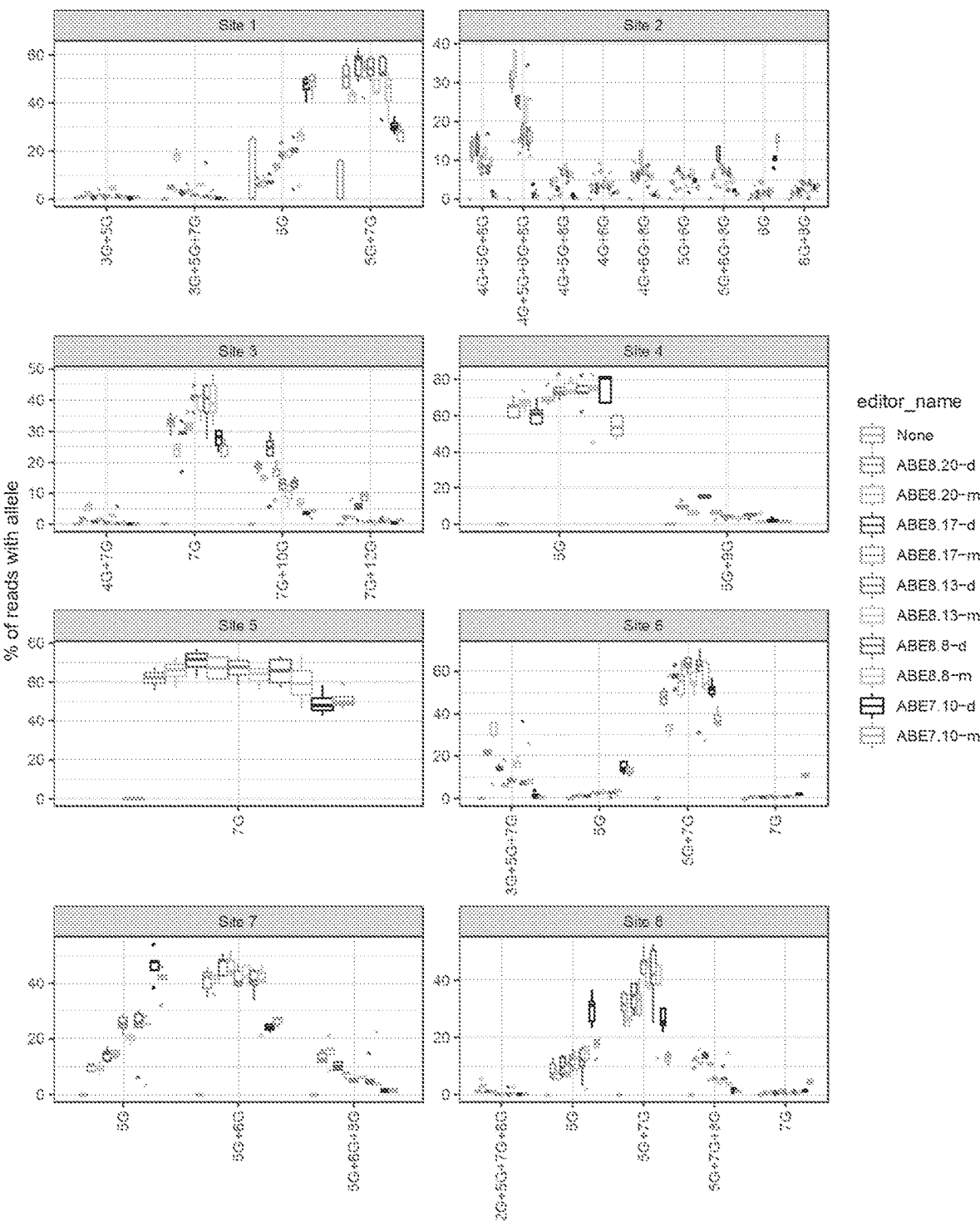
FIG. 7 are graphs depicting alleles created by ABEs across 8 different genomic sites in HEK293T cells.

All targeted NGS data were analyzed by performing four general steps: (1) Illumina demultiplexing, (2) read trimming and filtering, (3) alignment of all reads to the expected amplicon sequence, and (4) generation of alignment statistics and quantification of editing rates. Each step is described in more detail in the following paragraphs. The haplotypes generated by ABE7 and ABE8 at different genetic loci is shown in FIG. 7.

1. To generate FASTQ files from the base call files (BCF) generated by the MiSeq, demultiplexing was performed by running Illumina bcl2fastq (v2.20.0.422) with the following parameters:

```
bcl2fastq \
  --ignore-missing-bcls \
  --ignore-missing-filter \
  --ignore-missing-positions \
  --ignore-missing-controls \
  --auto-set-to-zero-barcode-mismatches \
  --find-adapters-with-sliding-window \
  --adapter-stringency 0.9 \
  --mask-short-adapter-reads 35 \
  --minimum-trimmed-read-length 35 \
```

2. The FASTQ files created in step (1) were processed using trimmomatic (v0.39) (Bolger, A. M., et al., Trimmomatic: a flexible trimmer for Illumina sequence data. Bioinformatics 30, 2114-2120, doi:10.1093/bioinformatics/btu170 (2014)) with parameters set up to clip Illumina TruSeq adapters, exclude reads shorter than 20 bases, and trim the remaining 3' end of reads if the average base quality (Phred score) in a 4-bp sliding window dropped below 15. In addition, any bases with quality scores of 3 or lower at the end of reads were removed. Finally, because the round 1 PCR primers include four randomized bases after the read 1 primer sequence, the first four bases of each read were trimmed. The command used to execute trimmomatic is shown below:

```
trimmomatic SE -phred33 $input_fastq $output_fastq \
ILLUMINACLIP:illumine_adapters.fa:2:30:10 \
LEADING:3 TRAILING:3 \
SLIDINGWINDOW:4:15 \
MINLEN:20 \
HEADCROP:4
```

3. Reads were aligned to amplicon sequences using bowtie2 (v2.35) (Langmead, B. & Salzberg, S. L., Fast gapped-read alignment with Bowtie 2. Nat Methods 9, 357-359, doi:10.1038/nmeth.1923 (2012)), in end-to-end mode with the alignment parameters specified by the—very sensitive flag. Reference sequences were determined as the expected amplicon sequences (including primers) for each primer pair based on the human genome (GRCh38). The SAM files created by bowtie2 were converted to BAM files, sorted, and indexed using the SAMtools package (v1.9) (Li, H. et al. The Sequence Alignment/Map format and SAMtools. Bioinformatics 25, 2078-2079, doi:10.1093/bioinformatics/btp352 (2009)). Only samples with at least 5,000 aligned reads were considered for analysis.

4. The BAM files created in step (3) were processed using the bam-readcounts tool (hgithub) to generate plain text files summarizing the number of non-reference bases, deletions and insertions at each position in the alignment. The minimum base quality (Phred score) for counting a non-reference base was set to 29 in order to exclude low confidence base calls from statistics about editing rates. Only reads with insertions and/or deletions that overlapped the base editor target site (defined as its protospacer+PAM sequence) were counted towards insertion and deletion rates. Editing rates for each position in the target site were calculated as the fraction of non-reference bases of a given type (e.g., G) to the total number of bases passing the base quality threshold at a given position in the alignment.

OTHER EMBODIMENTS

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SEQUENCE LISTING (935 sequences)

SEQ ID NO: 1 - protein, 1368 aa, Streptococcus pyogenes [sequence omitted]

SEQ ID NO: 2 - protein, 167 aa, Unknown
  Description of Unknown: TadA sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 3 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 4 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTD

SEQ ID NO: 5 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 6 - protein, 24 aa, Artificial Sequence
  Description of Artificial Sequence: Synthetic peptide
SGGSSGGSSGSETPGTSESATPES

SEQ ID NO: 7 - protein, 1052 aa, Artificial Sequence
  Description of Artificial Sequence: Synthetic polypeptide
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 8 - protein, 1368 aa, Streptococcus pyogenes [sequence omitted]

SEQ ID NO: 9 - protein, 166 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSST

SEQ ID NO: 10 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 11 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 12 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 13 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 14 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 15 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 16 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 17 - DNA, 8811 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 18 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 19 - DNA, 994 bp, Homo sapiens
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 20 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 21 - DNA, 9199 bp, Homo sapiens
catgtcataaatggtaagtccaagaaaaatacaggtattcccccccaaagaaaactgtaaaatcgacttttttctatctgtactgttttttattggtttttaaattggttttccaagtgagtaaatcagaatctatctgtaatggattttaaatttagtgtttctctgtgatgtagtaaacaagaaactagaggcaaaaatagccctgtcccttgctaaacttctaaggcacttttctagtacaactcaacactaacatttcaggcctttagtgccttatatgagtttttaaaagggggaaaagggagggagcaagagtgtcttaactcatacatttaggcataacaattattctcatattttagttattgagagggctggtagaaaaactaggtaaataatattaataattatagcgcttattaaacactacagaacacttactatgtaccaggcattgtgggaggctctctcttgtgcattatctcatttcattaggtccatggagagtattgcattttcttagtttaggcatggcctccacaataaagattatcaaaagcctaaaaatatgtaaaagaaacctagaagttatttgttgtgctccttggggaagctaggcaaatcctttcaactgaaaaccatggtgacttccaagatctctgcccctccccatcgccatggtccacttcctcttctcactgttcctcttagaaaagatctgtggactccaccaccacgaaatggcggcaccttatttatggtcactttagagggtaggttttcttaatgggtctgcctgtcatgtttaacgtccttggctgggtccaaggcagatgcagtccaaactctcactaaaattgccgagccctttgtcttccagtgtctaaaatattaatgtcaatggaatcaggccagagtttgaattctagtctcttagcctttgtttcccctgtccataaaatgaatgggggtaattctttcctcctacagtttatttatatattcactaattcattcattcatccatccattcgttcattcggtttactgagtacctactatgtgccagcccctgttctagggtggaaactaagagaatgatgtacctagagggcgctggaagctctaaagccctagcagttactgcttttactattagtggtcgtttttttctcccccccgccccccgacaaatcaacagaacaaagaaaattacctaaacagcaaggacatagggaggaacttcttggcacagaactttccaaacactttttcctgaagggatacaagaagcaagaaaggtactctttcactaggaccttctctgagctgtcctcaggatgcttttgggactatttttcttacccagagaatggagaaaccctgcagggaattcccaagctgtagttataaacagaagttctccttctgctaggtagcattcaaagatcttaatcttctgggtttccgttttctcgaatgaaaaatgcaggtccgagcagttaactggctggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaa

SEQ ID NO: 22 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 23 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 24 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 25 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 26 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 27 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 28 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 29 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 30 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 31 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1367 aa, Artificial Sequence
  Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 34 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 35 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 36 - protein, 986 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 37 - protein, 1210 aa, Unknown
  Description of Unknown: uncultured Parcubacteria group bacterium sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 38 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 39 - protein, 982 aa, Homo sapiens [sequence omitted]

SEQ ID NO: 40 - DNA, 2949 bp, Homo sapiens
atggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatag

SEQ ID NO: 41 - protein, 1130 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLQQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 42 - DNA, 4654 bp, Homo sapiens
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 43 - protein, 240 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 44 - DNA, 1284 bp, Homo sapiens
ctctctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctccaccagcgggggcctgcgtgggatctacctgaggcagctcgggccacagccccaagacatcatttactacgaggacggggtggtgcccactacggacagacggttccggggccgcatcgacttctcagggtcccaggacaacctgactatcaccatgcaccgcctgcagctgtcggacactggcacctacacctgccaggccatcacggaggtcaatgtctacggctccggcaccctggtcctggtgacagaggaacagtcccaaggatggcacagatgctcggacgccccaccaagggcctctgccctccctgccccaccgacaggctccgccctccctgacccgcagacagcctctgccctccctgacccgccagcagcctctgccctccctgcggccctggcggtgatctccttcctcctcgggctgggcctgggggtggcgtgtgtgctggcgaggacacagataaagaaactgtgctcgtggcgggataagaattcggcggcatgtgtggtgtacgaggacatgtcgcacagccgctgcaacacgctgtcctcccccaaccagtaccagtgacccagtgggcccctgcacgtcccgcctgtggtccccccagcaccttccctgccccaccatgccccccaccctgccacacccctcaccctgctgtcctcccacggctgcagcagagtttgaagggcccagccgtgcccagctccaagcagacacacaggcagtggccaggccccacggtgcttctcagtggacaatgatgcctcctccgggaagccttccctgcccagcccacgccgccaccgggaggaagcctgactgtcctttggctgcatctcccgaccatggccaaggagggcttttctgtgggatgggcctgggcacgcggccctctcctgtcagtgccggcccacccaccagcaggcccccaacccccaggcagcccggcagaggacgggaggagaccagtcccccacccagccgtaccagaaataaaggcttctgtgcttcc

SEQ ID NO: 45 - protein, 438 aa, Homo sapiens
MVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 46 - DNA, 3376 bp, Homo sapiens
gagtcttgctgatgctcccggctgaataaaccccttccttctttaacttggtgtctgaggggttttgtctgtggcttgtcctgctacatttcttggttccctgaccaggaagcaaagtgattaacggacagttgaggcagccccttaggcagcttaggcctgccttgtggagcatccccgcggggaactctggccagcttgagcgacacggatcctcagagcgctcccaggtaggcaattgccccagtggaatgcctcgtcagagcagtgcatggcaggcccctgtggaggatcaacgcagtggctgaacacagggaaggaactggcacttggagtccggacaactgaaacttgtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccacctgtcagcttatccagctctggaaggggctctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaaaaaaaaaaaaaaaaaaaaaaaa

SEQ ID NO: 47 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 48 - DNA, 748 bp, Homo sapiens
gacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgagg

SEQ ID NO: 49 - DNA, 306 bp, Unknown
  Description of Unknown: DnaE Intein-N sequence
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 50 - protein, 102 aa, Unknown
  Description of Unknown: DnaE Intein-N sequence
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 51 - DNA, 108 bp, Unknown
  Description of Unknown: DnaE Intein-C sequence
atgatcaagatagctacaaggaagtatcttggcaaacaaaacgtttatgatattggagtcgaaagagatcacaactttgctctgaagaacggattcatagcttctaat

SEQ ID NO: 52 - protein, 36 aa, Unknown
  Description of Unknown: Intein-C sequence
MIKIATRKYLGKQNVYDIGVERDHNFALKNGFIASN

SEQ ID NO: 53 - DNA, 303 bp, Artificial Sequence
  Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 54 - protein, 101 aa, Artificial Sequence
  Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 55 - DNA, 159 bp, Artificial Sequence
  Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 56 - protein, 53 aa, Artificial Sequence
  Description of Artificial Sequence: Synthetic polypeptide
MKRTADGSEFESPKKKRKVKIISRKSLGTQNVYDIGVEKDHNFLLKNGLVASN

SEQ ID NO: 57 - protein, 24 aa, Artificial Sequence
  Description of Artificial Sequence: Synthetic peptide
SGGSSGSETPGTSESATPESSGGS

SEQ ID NO: 58 - protein, 32 aa, Artificial Sequence
  Description of Artificial Sequence: Synthetic polypeptide
SGGSSGGSSGSETPGTSESATPESSGGSSGGS

SEQ ID NO: 59 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 60 - protein, 16 aa, Artificial Sequence
  Description of Artificial Sequence: Synthetic peptide
SGSETPGTSESATPES

SEQ ID NO: 61 - protein, 4 aa, Artificial Sequence
  Description of Artificial Sequence: Synthetic peptide
SGGS

SEQ ID NO: 62 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 63 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 64 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 65 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 66 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 67 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 68 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 69 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 70 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 71 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 72 - protein, 716 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 73 - DNA, 2978 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtaaaaaaaaaaaaaa

SEQ ID NO: 74 - protein, 18 aa, Artificial Sequence
  Description of Artificial Sequence: Synthetic peptide
KRTADGSEFESPKKKRKV

SEQ ID NO: 75 - protein, 16 aa, Artificial Sequence
  Description of Artificial Sequence: Synthetic peptide
KRPAATKKAGQAKKKK

SEQ ID NO: 76 - protein, 17 aa, Artificial Sequence
  Description of Artificial Sequence: Synthetic peptide
KKTELQTTNAENKTKKL

SEQ ID NO: 77 - protein, 19 aa, Artificial Sequence
  Description of Artificial Sequence: Synthetic peptide
KRGINDRNFWRGENGRKTR

SEQ ID NO: 78 - protein, 16 aa, Artificial Sequence
  Description of Artificial Sequence: Synthetic peptide
RKSGKIAAIVVKRPRK

SEQ ID NO: 79 - protein, 7 aa, Artificial Sequence
  Description of Artificial Sequence: Synthetic peptide
PKKKRKV

SEQ ID NO: 80 - protein, 30 aa, Artificial Sequence
  Description of Artificial Sequence: Synthetic polypeptide
MDSLLMNRRKFLYQFKNVRWAKGRRETYLC

SEQ ID NO: 81 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 82 - DNA, 867 bp, Homo sapiens
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctga

SEQ ID NO: 83 - protein, 2002 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 84 - DNA, 10178 bp, Homo sapiens
ccgtgccatcccaacctcccacctcgcccccaaccttcgcgcttgctctgcttcttctcccaggggtggagacccgccgaggtccccggggttcccgagggctgcacccttccccgcgctcgccagccctggcccctactccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcaaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgaagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaagtgttgtcttcct

SEQ ID NO: 85 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 86 - DNA, 2090 bp, Homo sapiens
gttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggcccctcctggctggcgagcgggcgccacatctggcccgcacatctgcgctgccggcccggcgcggggtccggagagggcgcggcgcggagcgcagccaggggtccgggaaggcgccgtccgtgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgctgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttatggggcaggctgggcatgtccaaagaggctgcccctctcaccaaa

SEQ ID NO: 87 - protein, 244 aa, Homo sapiens
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 88 - DNA, 831 bp, Homo sapiens
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctgg

SEQ ID NO: 89 - protein, 140 aa, Homo sapiens
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 90 - DNA, 1508 bp, Homo sapiens
ttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgatctcgaaccgaacagcagtgcttccaagataatctttggatcagggaccagactcagcatccggccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggtaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctggagaatgttgtgaggggtttatttttttttaatagtgttcataaagaaatacatagtattcttcttctcaagacgtggggggaaattatctcattatcgaggccctgctatgctgtgtgtctgggcgtgttgtatgtcctgctgccgatgccttcattaaaatgatttggaa

SEQ ID NO: 91 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 92 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 93 - DNA, 2468 bp, Homo sapiens
gcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacaccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgaaaaaaaaaaaaaaaaaaaaaaaaaaaaaaaaaaaaaaaaaaaaaaaaaaaaaaaaaaaaaaa

SEQ ID NO: 94 - protein, 493 aa, Artificial Sequence
  Description of Artificial Sequence: Synthetic polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 95 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacagagucucucagcugguacac

SEQ ID NO: 96 - RNA, 119 nt, Artificial Sequence
  Description of Artificial Sequence: Synthetic polynucleotide
guucugucuuuuggucaggacaaccgucuagcuauaagugcugcagggugugaggaaacuccuauugcuggacgaugucucuuacgaggcauuagcacaccgauuuugauucucaaaca

SEQ ID NO: 97 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacucaaacaaaugugcacaaag

SEQ ID NO: 98 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacucaaacaaaugugucacaaag

SEQ ID NO: 99 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacuuugagaaucaaaaucggua

SEQ ID NO: 100 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacugauguguauaucacagacaa

SEQ ID NO: 101 - RNA, 116 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcaguugcuccaggccacagcau

SEQ ID NO: 102 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacuuccagaagacaccuucuucc

SEQ ID NO: 103 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcaccagaagacaccuucuucccca

SEQ ID NO: 104 - RNA, 117 nt, Artificial Sequence
  Description of Artificial Sequence: Synthetic polynucleotide
guucugucuuuuggucaggacaaccgucuagcuauaagugcugcagggugugagagaaacuccuauugcuggacgaugucucuuacgaggcauuagcacgguuccgaauccuccuga

SEQ ID NO: 105 - RNA, 118 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacggaacccaaucacugacaggu

SEQ ID NO: 106 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacagagucucucagcugguaca

SEQ ID NO: 107 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacaccgauuuugauucucaaac

SEQ ID NO: 108 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacugauucucaaacaaaugugu

SEQ ID NO: 109 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacucaaacaaaugugucacaaa

SEQ ID NO: 110 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacguuugagaaucaaaaucggu

SEQ ID NO: 111 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacugauguguauaucacagaca

SEQ ID NO: 112 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacguugcuccaggccacagcac

SEQ ID NO: 113 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacuuccagaagacaccuucuuc

SEQ ID NO: 114 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcaccagaagacaccuucuucccc

SEQ ID NO: 115 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacgguuccgaauccuccuccug

SEQ ID NO: 116 - RNA, 117 nt, Artificial Sequence
  Description of Artificial Sequence: Synthetic polynucleotide
guucugucuuuuggucaggacaaccgucuagcuauaagugcugcagggugugagaaacuccuauugcuggacgaugucucuuacgaggcauuagcacggaacccaaucacugacagg

SEQ ID NO: 117 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacagagucucucagcugguaca

SEQ ID NO: 118 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacaccgauuuugauucucaaac

SEQ ID NO: 119 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacugauucucaaacaaaugugu

SEQ ID NO: 120 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacucaaacaaaugugucacaaa

SEQ ID NO: 121 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacguuugagaaucaaaaucggu

SEQ ID NO: 122 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacugauguguauaucacagaca

SEQ ID NO: 123 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacguugcuccaggccacagcac

SEQ ID NO: 124 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacuuccagaagacaccuucuuc

SEQ ID NO: 125 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcaccagaagacaccuucuucccc

SEQ ID NO: 126 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacgguuccgaauccuccuccug

SEQ ID NO: 127 - RNA, 108 nt, Artificial Sequence
  Description of Artificial Sequence: Synthetic polynucleotide
gaccuauagggucaaugaaucugugcgugugccauaaguaauuaaaaauuacccaccacaggagcaccugaaaacaggugcuuggcacggaacccaaucacugacagg

SEQ ID NO: 128 - DNA, 20 bp, Artificial Sequence
  Description of Artificial Sequence: Synthetic oligonucleotide
ctcgatgcgaggactctcca

SEQ ID NO: 129 - DNA, 20 bp, Artificial Sequence
  Description of Artificial Sequence: Synthetic oligonucleotide
tctcgatgcgaggactctcc

SEQ ID NO: 130 - DNA, 20 bp, Artificial Sequence
  Description of Artificial Sequence: Synthetic oligonucleotide
catcgagataacctcgtgct

SEQ ID NO: 131 - DNA, 20 bp, Artificial Sequence
  Description of Artificial Sequence: Synthetic oligonucleotide
tggccgggctcaggcacgag

SEQ ID NO: 132 - DNA, 20 bp, Artificial Sequence
  Description of Artificial Sequence: Synthetic oligonucleotide
gcccactggtaggggtgctg

SEQ ID NO: 133 - DNA, 20 bp, Artificial Sequence
  Description of Artificial Sequence: Synthetic oligonucleotide
tgggctcggtggtgggactt

SEQ ID NO: 134 - DNA, 20 bp, Artificial Sequence
  Description of Artificial Sequence: Synthetic oligonucleotide
cgagcccactacgagacgga

SEQ ID NO: 135 - DNA, 20 bp, Artificial Sequence
  Description of Artificial Sequence: Synthetic oligonucleotide
ctcgtagtgggctcggtggt

SEQ ID NO: 136 - DNA, 20 bp, Artificial Sequence
  Description of Artificial Sequence: Synthetic oligonucleotide
gccgtgaaggcgtcggccgg

SEQ ID NO: 137 - DNA, 20 bp, Artificial Sequence
  Description of Artificial Sequence: Synthetic oligonucleotide
gtttctgagtttcaggattc

SEQ ID NO: 138 - DNA, 20 bp, Artificial Sequence
  Description of Artificial Sequence: Synthetic oligonucleotide
catcgggaggaagaacacac

SEQ ID NO: 139 - DNA, 20 bp, Artificial Sequence
  Description of Artificial Sequence: Synthetic oligonucleotide
ggaggaagaacacacgggta

SEQ ID NO: 140 - DNA, 20 bp, Artificial Sequence
  Description of Artificial Sequence: Synthetic oligonucleotide
gagcgctgggctgcatcaga

SEQ ID NO: 141 - DNA, 20 bp, Artificial Sequence
  Description of Artificial Sequence: Synthetic oligonucleotide
tgatctcgatccgagggctc

SEQ ID NO: 142 - DNA, 20 bp, Artificial Sequence
  Description of Artificial Sequence: Synthetic oligonucleotide
acggagtgatctcgatccga

SEQ ID NO: 143 - DNA, 20 bp, Artificial Sequence
  Description of Artificial Sequence: Synthetic oligonucleotide
gcggaggcattcgtgcgccg

SEQ ID NO: 144 - DNA, 20 bp, Artificial Sequence
  Description of Artificial Sequence: Synthetic oligonucleotide
gccgcgctcagaaacttctg

SEQ ID NO: 145 - DNA, 20 bp, Artificial Sequence
  Description of Artificial Sequence: Synthetic oligonucleotide
gggcctcgggcctgagccct

SEQ ID NO: 146 - DNA, 20 bp, Artificial Sequence
  Description of Artificial Sequence: Synthetic oligonucleotide
cctcgggctggcggccaccc

SEQ ID NO: 147 - DNA, 20 bp, Artificial Sequence
  Description of Artificial Sequence: Synthetic oligonucleotide
ccactcgcccgtgccccgtc

SEQ ID NO: 148 - DNA, 20 bp, Artificial Sequence
  Description of Artificial Sequence: Synthetic oligonucleotide
gcattcgtgcgccgaggcct

SEQ ID NO: 149 - DNA, 20 bp, Artificial Sequence
  Description of Artificial Sequence: Synthetic oligonucleotide
gagcctcaccccagcgctcc

SEQ ID NO: 150 - DNA, 20 bp, Artificial Sequence
  Description of Artificial Sequence: Synthetic oligonucleotide
gaggggctccgggagcgctg

SEQ ID NO: 151 - DNA, 20 bp, Artificial Sequence
  Description of Artificial Sequence: Synthetic oligonucleotide
agggctggtcttccacatct

SEQ ID NO: 152 - DNA, 20 bp, Artificial Sequence
  Description of Artificial Sequence: Synthetic oligonucleotide
gcggggagcccaggccaaag

SEQ ID NO: 153 - DNA, 20 bp, Artificial Sequence
  Description of Artificial Sequence: Synthetic oligonucleotide
gccaccatgaagaccttttg

SEQ ID NO: 154 - DNA, 20 bp, Artificial Sequence
  Description of Artificial Sequence: Synthetic oligonucleotide
ttgcggcacacctgagtacc

SEQ ID NO: 155 - DNA, 20 bp, Artificial Sequence
  Description of Artificial Sequence: Synthetic oligonucleotide
gtaggagaactgggggaagt

SEQ ID NO: 156 - DNA, 20 bp, Artificial Sequence
  Description of Artificial Sequence: Synthetic oligonucleotide
ctcctactcggccagcggca

SEQ ID NO: 157 - DNA, 20 bp, Artificial Sequence
  Description of Artificial Sequence: Synthetic oligonucleotide
gaaaaccttctgtgggaccc

SEQ ID NO: 158 - DNA, 20 bp, Artificial Sequence
  Description of Artificial Sequence: Synthetic oligonucleotide
agtaggagaactgggggaag

SEQ ID NO: 159 - DNA, 20 bp, Artificial Sequence
  Description of Artificial Sequence: Synthetic oligonucleotide
gttgcaagtctgacatttga

SEQ ID NO: 160 - DNA, 20 bp, Artificial Sequence
  Description of Artificial Sequence: Synthetic oligonucleotide
gaaacactacctggtacaca

SEQ ID NO: 161 - DNA, 20 bp, Artificial Sequence
  Description of Artificial Sequence: Synthetic oligonucleotide
tgtggcagacctacagtgta

SEQ ID NO: 162 - DNA, 20 bp, Artificial Sequence
  Description of Artificial Sequence: Synthetic oligonucleotide
gggcacaccttgcattggta

SEQ ID NO: 163 - DNA, 20 bp, Artificial Sequence
  Description of Artificial Sequence: Synthetic oligonucleotide
ctgcgcacctggcattcatg

SEQ ID NO: 164 - DNA, 20 bp, Artificial Sequence
  Description of Artificial Sequence: Synthetic oligonucleotide
cctaccggtccgcaagcgtc

SEQ ID NO: 165 - DNA, 20 bp, Artificial Sequence
  Description of Artificial Sequence: Synthetic oligonucleotide
actcacacatctggataggt

SEQ ID NO: 166 - DNA, 20 bp, Artificial Sequence
  Description of Artificial Sequence: Synthetic oligonucleotide
gacttacctagaccttcctg

SEQ ID NO: 167 - DNA, 20 bp, Artificial Sequence
  Description of Artificial Sequence: Synthetic oligonucleotide
aatcttacagagctgaaaag

SEQ ID NO: 168 - DNA, 20 bp, Artificial Sequence
  Description of Artificial Sequence: Synthetic oligonucleotide
catcatattcttcacttcca

SEQ ID NO: 169 - DNA, 20 bp, Artificial Sequence
  Description of Artificial Sequence: Synthetic oligonucleotide
aagaatatgatgttcctccc

SEQ ID NO: 170 - DNA, 20 bp, Artificial Sequence
  Description of Artificial Sequence: Synthetic oligonucleotide
cccctaaaccacgaccgcgc

SEQ ID NO: 171 - DNA, 20 bp, Artificial Sequence
  Description of Artificial Sequence: Synthetic oligonucleotide
tcctgcgcggtcgtggttta

SEQ ID NO: 172 - DNA, 20 bp, Artificial Sequence
  Description of Artificial Sequence: Synthetic oligonucleotide
ccctactctgtgaccaactg

SEQ ID NO: 173 - DNA, 20 bp, Artificial Sequence
  Description of Artificial Sequence: Synthetic oligonucleotide
cgcaggcgcgtcttccaggt

SEQ ID NO: 174 - DNA, 20 bp, Artificial Sequence
  Description of Artificial Sequence: Synthetic oligonucleotide
gcaccgcaggcgcgtcttcc

SEQ ID NO: 175 - DNA, 20 bp, Artificial Sequence
  Description of Artificial Sequence: Synthetic oligonucleotide
gaacaagagcaatgactttg

SEQ ID NO: 176 - DNA, 20 bp, Artificial Sequence
  Description of Artificial Sequence: Synthetic oligonucleotide
cacctacctaagaaccatcc

SEQ ID NO: 177 - DNA, 20 bp, Artificial Sequence
  Description of Artificial Sequence: Synthetic oligonucleotide
ggggttccagggcctgtctg

SEQ ID NO: 178 - DNA, 20 bp, Artificial Sequence
  Description of Artificial Sequence: Synthetic oligonucleotide
gacttgcacaacatgcagaa

SEQ ID NO: 179 - DNA, 20 bp, Artificial Sequence
  Description of Artificial Sequence: Synthetic oligonucleotide
ttgccagaagcaagatccca

SEQ ID NO: 180 - DNA, 20 bp, Artificial Sequence
  Description of Artificial Sequence: Synthetic oligonucleotide
ccatgaacaaccaaaagaga

SEQ ID NO: 181 - DNA, 20 bp, Artificial Sequence
  Description of Artificial Sequence: Synthetic oligonucleotide
tcacccccatccagaagccg

SEQ ID NO: 182 - DNA, 20 bp, Artificial Sequence
  Description of Artificial Sequence: Synthetic oligonucleotide
atctggctggtctcgtccag

SEQ ID NO: 183 - DNA, 20 bp, Artificial Sequence
  Description of Artificial Sequence: Synthetic oligonucleotide
gatgagcgacctcccggtga

SEQ ID NO: 184 - DNA, 20 bp, Artificial Sequence
  Description of Artificial Sequence: Synthetic oligonucleotide
agacagcgatgacgtctctg

SEQ ID NO: 185 - DNA, 20 bp, Artificial Sequence
  Description of Artificial Sequence: Synthetic oligonucleotide
acgtctctgaggtggacgcg

SEQ ID NO: 186 - DNA, 20 bp, Artificial Sequence
  Description of Artificial Sequence: Synthetic oligonucleotide
ttaggggagagtttctcggc

SEQ ID NO: 187 - DNA, 20 bp, Artificial Sequence
  Description of Artificial Sequence: Synthetic oligonucleotide
ggagagtgaggaggaggaag

SEQ ID NO: 188 - DNA, 20 bp, Artificial Sequence
  Description of Artificial Sequence: Synthetic oligonucleotide
aaggctccgaatccgaatct

SEQ ID NO: 189 - DNA, 20 bp, Artificial Sequence
  Description of Artificial Sequence: Synthetic oligonucleotide
atcgtcactcacgaccggct

SEQ ID NO: 190 - DNA, 20 bp, Artificial Sequence
  Description of Artificial Sequence: Synthetic oligonucleotide
tgacagtgaggaggaacaag

SEQ ID NO: 191 - DNA, 20 bp, Artificial Sequence
  Description of Artificial Sequence: Synthetic oligonucleotide
cacccgtggttgttacactc

SEQ ID NO: 192 - DNA, 20 bp, Artificial Sequence
  Description of Artificial Sequence: Synthetic oligonucleotide
catcagccaggccccgcagg

SEQ ID NO: 193 - DNA, 20 bp, Artificial Sequence
  Description of Artificial Sequence: Synthetic oligonucleotide
ggtgtatccatctgagttga

SEQ ID NO: 194 - DNA, 20 bp, Artificial Sequence
  Description of Artificial Sequence: Synthetic oligonucleotide
gggtgtatccatctgagttg

SEQ ID NO: 195 - DNA, 20 bp, Artificial Sequence
  Description of Artificial Sequence: Synthetic oligonucleotide
gcgcaagaagcagatcgacg

SEQ ID NO: 196 - DNA, 20 bp, Artificial Sequence
  Description of Artificial Sequence: Synthetic oligonucleotide
ttactacagcctggccagca

SEQ ID NO: 197 - protein, 4 aa, Artificial Sequence
  Description of Artificial Sequence: Synthetic peptide
SGGS

SEQ ID NO: 198 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 199 - protein, 987 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 200 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 201 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 202 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 203 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 204 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 205 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 206 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 207 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 208 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 209 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 210 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 211 - protein, 1129 aa, Alicyclobacillus acidiphilus
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 212 - RNA, 120 nt, Artificial Sequence
  Description of Artificial Sequence: Synthetic polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 213 - DNA, 47 bp, Artificial Sequence
  Description of Artificial Sequence: Synthetic oligonucleotide
gggaaataagagagaaaagaagagtaagaagaaatataagagccacc

SEQ ID NO: 214 - DNA, 101 bp, Artificial Sequence
  Description of Artificial Sequence: Synthetic polynucleotide
gctggagcctcggtggccatgcttcttgccccttgggcctccccccagcccctcctccccttcctgcacccgtacccccgtggtctttgaataaagtctga

SEQ ID NO: 215 - DNA, 3420 bp, Artificial Sequence
  Description of Artificial Sequence: Synthetic polynucleotide
atggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaag

SEQ ID NO: 216 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 217 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 218 - protein, 1302 aa, Unknown
  Description of Unknown: Cas12c1 sequence
MQTKKTHLHLISAKASRKYRRTIACLSDTAKKDLERRKQSGAADPAQELSCLKTIKFKLEVPEGSKLPSFDRISQIYNALETIEKGSLSYLLFALILSGFRIFPNSSAAKTFASSSCYKNDQFASQIKEIFGEMVKNFIPSELESILKKGRRKNNKDWTEENIKRVLNSEFGRKNSEGSSALFDSFLSKFSQELFRKFDSWNEVNKKYLEAAELLDSMLASYGPFDSVCKMIGDSDSRNSLPDKSTIAFTNNAEITVDIESSVMPYMAIAALLREYRQSKSKAAPVAYVQSHLTTTNGNGLSWFFKFGLDLIRKAPVSSKQSTSDGSKSLQELFSVPDDKLDGLKFIKEACEALPEASLLCGEKGELLGYQDFRTSFAGHIDSWVANYVNRLFELIELVNQLPESIKLPSILTQKNHNLVASLGLQEAEVSHSLELFEGLVKNVRQTLKKLAGIDISSSPNEQDIKEFYAFSDVLNRLGSIRNQIENAVQTAKKDKIDLESAIEWKEWKKLKKLPKLNGLGGGVPKQQELLDKALESVKQIRHYQRIDFERVIQWAVNEHCLETVPKFLVDAEKKKINKESSTDFAAKENAVRFLLEGIGAAARGKTDSVSKAAYNWFVVNNFLAKKDLNRYFINCQGCIYKPPYSKRRSLAFALRSDNKDTIEVVWEKFETFYKEISKEIEKFNIFSQEFQTFLHLENLRMKLLLRRIQKPIPAEIAFFSLPQEYYDSLPPNVAFLALNQEITPSEYITQFNLYSSFLNGNLILLRRSRSYLRAKFSWVGNSKLIYAAKEARLWKIPNAYWKSDEWKMILDSNVLVFDKAGNVLPAPTLKKVCEREGDLRLFYPLLRQLPHDWCYRNPFVKSVGREKNVIEVNKEGEPKVASALPGSLFRLIGPAPFKSLLDDCFFNPLDKDLRECMLIVDQEISQKVEAQKVEASLESCTYSIAVPIRYHLEEPKVSNQFENVLAIDQGEAGLAYAVFSLKSIGEAETKPIAVGTIRIPSIRRLIHSVSTYRKKKQRLQNFKQNYDSTAFIMRENVTGDVCAKIVGLMKEFNAFPVLEYDVKNLESGSRQLSAVYKAVNSHFLYFKEPGRDALRKQLWYGGDSWTIDGIEIVTRERKEDGKEGVEKIVPLKVFPGRSVSARFTSKTCSCCGRNVFDWLFTEKKAKTNKKFNVNSKGELTTADGVIQLFEADRSKGPKFYARRKERTPLTKPIAKGSYSLEEIERRVRTNLRRAPKSKQSRDTSQSQYFCVYKDCALHFSGMQADENAAINIGRRFLTALRKNRRSDFPSNVKISDRLLDN

SEQ ID NO: 219 - protein, 1218 aa, Unknown
  Description of Unknown: Cas12c2 sequence
MTKHSIPLHAFRNSGADARKWKGRIALLAKRGKETMRTLQFPLEMSEPEAAAINTTPFAVAYNAIEGTGKGTLFDYWAKLHLAGFRFFPSGGAATIFRQQAVFEDASWNAAFCQQSGKDWPWLVPSKLYERFTKAPREVAKKDGSKKSIEFTQENVANESHVSLVGASITDKTPEDQKEFFLKMAGALAEKFDSWKSANEDRIVAMKVIDEFLKSEGLHLPSLENIAVKCSVETKPDNATVAWHDAPMSGVQNLAIGVFATCASRIDNIYDLNGGKLSKLIQESATTPNVTALSWLFGKGLEYFRTTDIDTIMQDFNIPASAKESIKPLVESAQAIPTMTVLGKKNYAPFRPNFGGKIDSWIANYASRLMLLNDILEQIEPGFELPQALLDNETLMSGIDMTGDELKELIEAVYAWVDAAKQGLATLLGRGGNVDDAVQTFEQFSAMMDTLNGTLNTISARYVRAVEMAGKDEARLEKLIECKFDIPKWCKSVPKLVGISGGLPKVEEEIKVMNAAFKDVRARMFVRFEEIAAYVASKGAGMDVYDALEKRELEQIKKLKSAVPERAHIQAYRAVLHRIGRAVQNCSEKTKQLFSSKVIEMGVFKNPSHLNNFIFNQKGAIYRSPFDRSRHAPYQLHADKLLKNDWLELLAEISATLMASESTEQMEDALRLERTRLQLQLSGLPDWEYPASLAKPDIEVEIQTALKMQLAKDTVTSDVLQRAFNLYSSVLSGLTFKLLRRSFSLKMRFSVADTTQLIYVPKVCDWAIPKQYLQAEGEIGIAARVVTESSPAKMVTEVEMKEPKALGHFMQQAPHDWYFDASLGGTQVAGRIVEKGKEVGKERKLVGYRMRGNSAYKTVLDKSLVGNTELSQCSMIIEIPYTQTVDADFRAQVQAGLPKVSINLPVKETITASNKDEQMLFDRFVAIDLGERGLGYAVFDAKTLELQESGHRPIKAITNLLNRTHHYEQRPNQRQKFQAKFNVNLSELRENTVGDVCHQINRICAYYNAFPVLEYMVPDRLDKQLKSVYESVTNRYIWSSTDAHKSARVQFWLGGETWEHPYLKSAKDKKPLVLSPGRGASGKGTSQTCSCCGRNPFDLIKDMKPRAKIAVVDGKAKLENSELKLFERNLESKDDMLARRHRNERAGMEQPLTPGNYTVDEIKALLRANLRRAPKNRRTKDTTVSEYHCVFSDCGKTMHADENAAVNIGGKFIADIEK

SEQ ID NO: 220 - protein, 1252 aa, Oleiphilus sp.
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 221 - protein, 767 aa, Unknown
  Description of Unknown: Cas12g1 sequence
MAQASSTPAVSPRPRPRYREERTLVRKLLPRPGQSKQEFRENVKKLRKAFLQFNADVSGVCQWAIQFRPRYGKPAEPTETFWKFFLEPETSLPPNDSRSPEFRRLQAFEAAAGINGAAALDDPAFTNELRDSILAVASRPKTKEAQRLFSRLKDYQPAHRMILAKVAAEWIESRYRRAHQNWERNYEEWKKEKQEWEQNHPELTPEIREAFNQIFQQLEVKEKRVRICPAARLLQNKDNCQYAGKNKHSVLCNQFNEFKKNHLQGKAIKFFYKDAEKYLRCGLQSLKPNVQGPFREDWNKYLRYMNLKEETLRGKNGGRLPHCKNLGQECEFNPHTALCKQYQQQLSSRPDLVQHDELYRKWRREYWREPRKPVFRYPSVKRHSIAKIFGENYFQADFKNSVVGLRLDSMPAGQYLEFAFAPWPRNYRPQPGETEISSVHLHFVGTRPRIGFRFRVPHKRSRFDCTQEELDELRSRTFPRKAQDQKFLEAARKRLLETFPGNAEQELRLLAVDLGTDSARAAFFIGKTFQQAFPLKIVKIEKLYEQWPNQKQAGDRRDASSKQPRPGLSRDHVGRHLQKMRAQASEIAQKRQELTGTPAPETTTDQAAKKATLQPFDLRGLTVHTARMIRDWARLNARQIIQLAEENQVDLIVLESLRGFRPPGYENLDQEKKRRVAFFAHGRIRRKVTEKAVERGMRVVTVPYLASSKVCAECRKKQKDNKQWEKNKKRGLFKCEGCGSQAQVDENAARVLGRVFWGEIELPTAIP

SEQ ID NO: 222 - protein, 870 aa, Unknown
  Description of Unknown: Cas12h1 sequence
MKVHEIPRSQLLKIKQYEGSFVEWYRDLQEDRKKFASLLFRWAAFGYAAREDDGATYISPSQALLERRLLLGDAEDVAIKFLDVLFKGGAPSSSCYSLFYEDFALRDKAKYSGAKREFIEGLATMPLDKIIERIRQDEQLSKIPAEEWLILGAEYSPEEIWEQVAPRIVNVDRSLGKQLRERLGIKCRRPHDAGYCKILMEVVARQLRSHNETYHEYLNQTHEMKTKVANNLTNEFDLVCEFAEVLEEKNYGLGWYVLWQGVKQALKEQKKPTKIQIAVDQLRQPKFAGLLTAKWRALKGAYDTWKLKKRLEKRKAFPYMPNWDNDYQIPVGLTGLGVFTLEVKRTEVVVDLKEHGKLFCSHSHYFGDLTAEKHPSRYHLKFRHKLKLRKRDSRVEPTIGPWIEAALREITIQKKPNGVFYLGLPYALSHGIDNFQIAKRFFSAAKPDKEVINGLPSEMVVGAADLNLSNIVAPVKARIGKGLEGPLHALDYGYGELIDGPKILTPDGPRCGELISLKRDIVEIKSAIKEFKACQREGLTMSEETTTWLSEVESPSDSPRCMIQSRIADTSRRLNSFKYQMNKEGYQDLAEALRLLDAMDSYNSLLESYQRMHLSPGEQSPKEAKFDTKRASFRDLLRRRVAHTIVEYFDDCDIVFFEDLDGPSDSDSRNNALVKLLSPRTLLLYIRQALEKRGIGMVEVAKDGTSQNNPISGHVGWRNKQNKSEIYFYEDKELLVMDADEVGAMNILCRGLNHSVCPYSFVTKAPEKKNDEKKEGDYGKRVKRFLKDRYGSSNVRFLVASMGFVTVTTKRPKDALVGKRLYYHGGELVTHDLHNRMKDEIKYLVEKEVLARRVSLSDSTIKSYKSFAHV

SEQ ID NO: 223 - protein, 1093 aa, Unknown
  Description of Unknown: Cas12i1 sequence
MSNKEKNASETRKAYTTKMIPRSHDRMKLLGNFMDYLMDGTPIFFELWNQFGGGIDRDIISGTANKDKISDDLLLAVNWFKVMPINSKPQGVSPSNLANLFQQYSGSEPDIQAQEYFASNFDTEKHQWKDMRVEYERLLAELQLSRSDMHHDLKLMYKEKCIGLSLSTAHYITSVMFGTGAKNNRQTKHQFYSKVIQLLEESTQINSVEQLASIILKAGDCDSYRKLRIRCSRKGATPSILKIVQDYELGTNHDDEVNVPSLIANLKEKLGRFEYECEWKCMEKIKAFLASKVGPYYLGSYSAMLENALSPIKGMTTKNCKFVLKQIDAKNDIKYENEPFGKIVEGFFDSPYFESDTNVKWVLHPHHIGESNIKTLWEDLNAIHSKYEEDIASLSEDKKEKRIKVYQGDVCQTINTYCEEVGKEAKTPLVQLLRYLYSRKDDIAVDKIIDGITFLSKKHKVEKQKINPVIQKYPSFNFGNNSKLLGKIISPKDKLKHNLKCNRNQVDNYIWIEIKVLNTKTMRWEKHHYALSSTRFLEEVYYPATSENPPDALAARFRTKTNGYEGKPALSAEQIEQIRSAPVGLRKVKKRQMRLEAARQQNLLPRYTWGKDFNINICKRGNNFEVTLATKVKKKKEKNYKVVLGYDANIVRKNTYAAIEAHANGDGVIDYNDLPVKPIESGFVTVESQVRDKSYDQLSYNGVKLLYCKPHVESRRSFLEKYRNGTMKDNRGNNIQIDFMKDFEAIADDETSLYYFNMKYCKLLQSSIRNHSSQAKEYREEIFELLRDGKLSVLKLSSLSNLSFVMFKVAKSLIGTYFGHLLKKPKNSKSDVKAPPITDEDKQKADPEMFALRLALEEKRLNKVKSKKEVIANKIVAKALELRDKYGPVLIKGENISDTTKKGKKSSTNSFLMDWLARGVANKVKEMVMMHQGLEFVEVNPNFTSHQDPFVHKNPENTFRARYSRCTPSELTEKNRKEILSFLSDKPSKRPTNAYYNEGAMAFLATYGLKKNDVLGVSLEKFKQIMANILHQRSEDQLLFPSRGGMFYLATYKLDADATSVNWNGKQFWVCNADLVAAYNVGLVDIQKDFKKK

SEQ ID NO: 224 - protein, 1054 aa, Unknown
  Description of Unknown: Cas12i2 sequence
MSSAIKSYKSVLRPNERKNQLLKSTIQCLEDGSAFFFKMLQGLFGGITPEIVRFSTEQEKQQQDIALWCAVNWFRPVSQDSLTHTIASDNLVEKFEEYYGGTASDAIKQYFSASIGESYYWNDCRQQYYDLCRELGVEVSDLTHDLEILCREKCLAVATESNQNNSIISVLFGTGEKEDRSVKLRITKKILEAISNLKEIPKNVAPIQEIILNVAKATKETFRQVYAGNLGAPSTLEKFIAKDGQKEFDLKKLQTDLKKVIRGKSKERDWCCQEELRSYVEQNTIQYDLWAWGEMFNKAHTALKIKSTRNYNFAKQRLEQFKEIQSLNNLLVVKKLNDFFDSEFFSGEETYTICVHHLGGKDLSKLYKAWEDDPADPENAIVVLCDDLKNNFKKEPIRNILRYIFTIRQECSAQDILAAAKYNQQLDRYKSQKANPSVLGNQGFTWTNAVILPEKAQRNDRPNSLDLRIWLYLKLRHPDGRWKKHHIPFYDTRFFQEIYAAGNSPVDTCQFRTPRFGYHLPKLTDQTAIRVNKKHVKAAKTEARIRLAIQQGTLPVSNLKITEISATINSKGQVRIPVKFDVGRQKGTLQIGDRFCGYDQNQTASHAYSLWEVVKEGQYHKELGCFVRFISSGDIVSITENRGNQFDQLSYEGLAYPQYADWRKKASKFVSLWQITKKNKKKEIVTVEAKEKFDAICKYQPRLYKFNKEYAYLLRDIVRGKSLVELQQIRQEIFRFIEQDCGVTRLGSLSLSTLETVKAVKGIIYSYFSTALNASKNNPISDEQRKEFDPELFALLEKLELIRTRKKKQKVERIANSLIQTCLENNIKFIRGEGDLSTTNNATKKKANSRSMDWLARGVFNKIRQLAPMHNITLFGCGSLYTSHQDPLVHRNPDKAMKCRWAAIPVKDIGDWVLRKLSQNLRAKNIGTGEYYHQGVKEFLSHYELQDLEEELLKWRSDRKSNIPCWVLQNRLAEKLGNKEAVVYIPVRGGRIYFATHKVATGAVSIVFDQKQVWVCNADHVAAANIALTVKGIGEQSSDEENPDGSRIKLQLTS

SEQ ID NO: 225 - protein, 6 aa, Artificial Sequence
  Description of Artificial Sequence: Synthetic peptide
GGSGGS

SEQ ID NO: 226 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatcccggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 227 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 228 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaaggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 229 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 230 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 231 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 232 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 233 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 234 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 235 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 236 - protein, 7 aa, Artificial Sequence
  Description of Artificial Sequence: Synthetic peptide
GGGSGGS

SEQ ID NO: 237 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESVLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 238 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 239 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 240 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 241 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 242 - protein, 29 aa, Artificial Sequence
  Description of Artificial Sequence: Synthetic peptide
PKKKRKVEGADKRTADGSEFESPKKKRKV

SEQ ID NO: 243 - protein, 23 aa, Artificial Sequence
  Description of Artificial Sequence: Synthetic peptide
RKSGKIAAIVVKRPRKPKKKRKV

SEQ ID NO: 244 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 245 - protein, 167 aa, Escherichia coli; identical to SEQ ID NO: 3

SEQ ID NO: 246 - protein, 8 aa, Artificial Sequence
  Description of Artificial Sequence: Synthetic peptide
SGGSSGGS

SEQ ID NO: 247 - protein, 1609 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 248 - protein, 1807 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDGGSSGGSSGSETPGTSESATPESSGGSSGGSMSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 249 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 250 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 251 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 252 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 253 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 254 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 255 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 256 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 257 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 258 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 259 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 260 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 261 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 262 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 263 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 264 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 265 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHYPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 266 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRRVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 267 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 268 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 269 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 270 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 271 - protein, 4 aa, Artificial Sequence
  Description of Artificial Sequence: Synthetic peptide
GGGS

SEQ ID NO: 272 - protein, 5 aa, Artificial Sequence
  Description of Artificial Sequence: Synthetic peptide
GGGGS

SEQ ID NO: 273 - protein, 5 aa, Artificial Sequence
  Description of Artificial Sequence: Synthetic peptide
EAAAK

SEQ ID NO: 274 - protein, 21 aa, Artificial Sequence
  Description of Artificial Sequence: Synthetic peptide
  MISC_FEATURE (1)..(21): This sequence may encompass 1, 3, or 7 "Gly Gly Ser" repeating units
GGSGGSGGSGGSGGSGGSGGS

SEQ ID NO: 275 - protein, 5 aa, Artificial Sequence
  Description of Artificial Sequence: Synthetic peptide
PAPAP

SEQ ID NO: 276 - protein, 6 aa, Artificial Sequence
  Description of Artificial Sequence: Synthetic peptide
PAPAPA

SEQ ID NO: 277 - protein, 7 aa, Artificial Sequence
  Description of Artificial Sequence: Synthetic peptide
PAPAPAP

SEQ ID NO: 278 - protein, 8 aa, Artificial Sequence
  Description of Artificial Sequence: Synthetic peptide
PAPAPAPA

SEQ ID NO: 279 - protein, 9 aa, Artificial Sequence
  Description of Artificial Sequence: Synthetic peptide
PAPAPAPAP

SEQ ID NO: 280 - protein, 15 aa, Artificial Sequence
  Description of Artificial Sequence: Synthetic peptide
PAPAPAPAPAPAPAP

SEQ ID NO: 281 - protein, 21 aa, Artificial Sequence
  Description of Artificial Sequence: Synthetic peptide
PAPAPAPAPAPAPAPAPAPAP

SEQ ID NO: 282 - DNA, 20 bp, Artificial Sequence
  Description of Artificial Sequence: Synthetic oligonucleotide
ccttacctagggacgcagcc

SEQ ID NO: 283 - DNA, 20 bp, Artificial Sequence
  Description of Artificial Sequence: Synthetic oligonucleotide
ggatccccagcgccagctgc

SEQ ID NO: 284 - DNA, 20 bp, Artificial Sequence
  Description of Artificial Sequence: Synthetic oligonucleotide
agcgccagctgccggcctcc

SEQ ID NO: 285 - DNA, 20 bp, Artificial Sequence
  Description of Artificial Sequence: Synthetic oligonucleotide
gcgccagctgccggcctcca

SEQ ID NO: 286 - DNA, 20 bp, Artificial Sequence
  Description of Artificial Sequence: Synthetic oligonucleotide
cctggctcagcgccacgggc

SEQ ID NO: 287 - DNA, 20 bp, Artificial Sequence
  Description of Artificial Sequence: Synthetic oligonucleotide
gctgcaggtgcagacaggtg

SEQ ID NO: 288 - DNA, 20 bp, Artificial Sequence
  Description of Artificial Sequence: Synthetic oligonucleotide
gcggtaccacgtcttgtaga

SEQ ID NO: 289 - DNA, 20 bp, Artificial Sequence
  Description of Artificial Sequence: Synthetic oligonucleotide
tgcctgtgggaacaaacaga

SEQ ID NO: 290 - DNA, 20 bp, Artificial Sequence
  Description of Artificial Sequence: Synthetic oligonucleotide
cttactttcactatcctggg

SEQ ID NO: 291 - DNA, 20 bp, Artificial Sequence
  Description of Artificial Sequence: Synthetic oligonucleotide
tcccttactttcactatcct

SEQ ID NO: 292 - DNA, 20 bp, Artificial Sequence
  Description of Artificial Sequence: Synthetic oligonucleotide
ctcccaggatagtgaaagta

SEQ ID NO: 293 - DNA, 20 bp, Artificial Sequence
  Description of Artificial Sequence: Synthetic oligonucleotide
tgatgtctgaaagggcagag

SEQ ID NO: 294 - DNA, 20 bp, Artificial Sequence
  Description of Artificial Sequence: Synthetic oligonucleotide
tgcccaggagctggtgcgga

SEQ ID NO: 295 - DNA, 20 bp, Artificial Sequence
  Description of Artificial Sequence: Synthetic oligonucleotide
ttgctgccacagaaccagaa

SEQ ID NO: 296 - DNA, 20 bp, Artificial Sequence
  Description of Artificial Sequence: Synthetic oligonucleotide
attcaagggattgaaaaccc

SEQ ID NO: 297 - DNA, 20 bp, Artificial Sequence
  Description of Artificial Sequence: Synthetic oligonucleotide
acctgcccaggggatacccg

SEQ ID NO: 298 - DNA, 20 bp, Artificial Sequence
  Description of Artificial Sequence: Synthetic oligonucleotide
cagcggcagccttctgagtc

SEQ ID NO: 299 - DNA, 20 bp, Artificial Sequence
  Description of Artificial Sequence: Synthetic oligonucleotide
gctacaaacaagctcatctt

SEQ ID NO: 300 - DNA, 20 bp, Artificial Sequence
  Description of Artificial Sequence: Synthetic oligonucleotide
ccagccaagtacgtaagtag

SEQ ID NO: 301 - DNA, 20 bp, Artificial Sequence
  Description of Artificial Sequence: Synthetic oligonucleotide
ctggatatctgtgggacaag

SEQ ID NO: 302 - DNA, 20 bp, Artificial Sequence
  Description of Artificial Sequence: Synthetic oligonucleotide
cttacctgggctggggaaga

SEQ ID NO: 303 - DNA, 20 bp, Artificial Sequence
  Description of Artificial Sequence: Synthetic oligonucleotide
ttcgtatctgtaaaaccaag

SEQ ID NO: 304 - DNA, 20 bp, Artificial Sequence
  Description of Artificial Sequence: Synthetic oligonucleotide
tttcaaaacctgtcagtgat

SEQ ID NO: 305 - DNA, 20 bp, Artificial Sequence
  Description of Artificial Sequence: Synthetic oligonucleotide
ttcaaaacctgtcagtgatt

SEQ ID NO: 306 - DNA, 20 bp, Artificial Sequence
  Description of Artificial Sequence: Synthetic oligonucleotide
ggaccctgcatagagagaga

SEQ ID NO: 307 - DNA, 20 bp, Artificial Sequence
  Description of Artificial Sequence: Synthetic oligonucleotide
tgccccagcagacgggcacg

SEQ ID NO: 308 - DNA, 20 bp, Artificial Sequence
  Description of Artificial Sequence: Synthetic oligonucleotide
gttacctgggccatgtcccc

SEQ ID NO: 309 - DNA, 20 bp, Artificial Sequence
  Description of Artificial Sequence: Synthetic oligonucleotide
cttactgttagatttatatc

SEQ ID NO: 310 - DNA, 20 bp, Artificial Sequence
  Description of Artificial Sequence: Synthetic oligonucleotide
ttactgttagatttatatca

SEQ ID NO: 311 - DNA, 20 bp, Artificial Sequence
  Description of Artificial Sequence: Synthetic oligonucleotide
tttgctatggaaacacaaac

SEQ ID NO: 312 - DNA, 20 bp, Artificial Sequence
  Description of Artificial Sequence: Synthetic oligonucleotide
tccatagcaaatatccacat

SEQ ID NO: 313 - DNA, 20 bp, Artificial Sequence
  Description of Artificial Sequence: Synthetic oligonucleotide
gcagcaaccctcacaacctt

SEQ ID NO: 314 - DNA, 20 bp, Artificial Sequence
  Description of Artificial Sequence: Synthetic oligonucleotide
cagcaaccctcacaaccttt

SEQ ID NO: 315 - DNA, 20 bp, Artificial Sequence
  Description of Artificial Sequence: Synthetic oligonucleotide
aggcaggctcccctcgcctc

SEQ ID NO: 316 - DNA, 20 bp, Artificial Sequence
  Description of Artificial Sequence: Synthetic oligonucleotide
ggagcagcaggaccagcttc

SEQ ID NO: 317 - DNA, 20 bp, Artificial Sequence
  Description of Artificial Sequence: Synthetic oligonucleotide
caggaatacctgagctttct

SEQ ID NO: 318 - DNA, 20 bp, Artificial Sequence
  Description of Artificial Sequence: Synthetic oligonucleotide
aggttccagattccattgct

SEQ ID NO: 319 - DNA, 20 bp, Artificial Sequence
  Description of Artificial Sequence: Synthetic oligonucleotide
ctgggcccaggggctgaggc

SEQ ID NO: 320 - DNA, 20 bp, Artificial Sequence
  Description of Artificial Sequence: Synthetic oligonucleotide
gatcgagtggccccaggtcc

SEQ ID NO: 321 - DNA, 20 bp, Artificial Sequence
  Description of Artificial Sequence: Synthetic oligonucleotide
tcacccgacttctgaacgtg

SEQ ID NO: 322 - DNA, 20 bp, Artificial Sequence
  Description of Artificial Sequence: Synthetic oligonucleotide
ttacctgcccactgttagcc

SEQ ID NO: 323 - DNA, 20 bp, Artificial Sequence
  Description of Artificial Sequence: Synthetic oligonucleotide
gaagccacaggaagtctgtg

SEQ ID NO: 324 - DNA, 20 bp, Artificial Sequence
  Description of Artificial Sequence: Synthetic oligonucleotide
actccagttcctgacggctg

SEQ ID NO: 325 - DNA, 20 bp, Artificial Sequence
  Description of Artificial Sequence: Synthetic oligonucleotide
acctacaggagtacctgacg

SEQ ID NO: 326 - DNA, 20 bp, Artificial Sequence
  Description of Artificial Sequence: Synthetic oligonucleotide
ttcccagagcaccagagcca

SEQ ID NO: 327 - DNA, 20 bp, Artificial Sequence
  Description of Artificial Sequence: Synthetic oligonucleotide
acgttcagaagtcgggtgag

SEQ ID NO: 328 - DNA, 20 bp, Artificial Sequence
  Description of Artificial Sequence: Synthetic oligonucleotide
ttcagagcagtttgagacag

SEQ ID NO: 329 - DNA, 20 bp, Artificial Sequence
  Description of Artificial Sequence: Synthetic oligonucleotide
cctgctgggaaacagacaac

SEQ ID NO: 330 - DNA, 20 bp, Artificial Sequence
  Description of Artificial Sequence: Synthetic oligonucleotide
cactcacagtctagggtggc

SEQ ID NO: 331 - DNA, 20 bp, Artificial Sequence
  Description of Artificial Sequence: Synthetic oligonucleotide
caaccggcagcgagggaacg

SEQ ID NO: 332 - DNA, 20 bp, Artificial Sequence
  Description of Artificial Sequence: Synthetic oligonucleotide
acagggctggggcaggacag

SEQ ID NO: 333 - DNA, 20 bp, Artificial Sequence
  Description of Artificial Sequence: Synthetic oligonucleotide
catccaccagctcgcagcac

SEQ ID NO: 334 - DNA, 20 bp, Artificial Sequence
  Description of Artificial Sequence: Synthetic oligonucleotide
atccaccagctcgcagcaca

SEQ ID NO: 335 - DNA, 20 bp, Artificial Sequence
  Description of Artificial Sequence: Synthetic oligonucleotide
tccaccagctcgcagcacag

SEQ ID NO: 336 - DNA, 20 bp, Artificial Sequence
  Description of Artificial Sequence: Synthetic oligonucleotide
ccaccagctcgcagcacagg

SEQ ID NO: 337 - DNA, 20 bp, Artificial Sequence
  Description of Artificial Sequence: Synthetic oligonucleotide
tgtcacctggcaggaggagg

SEQ ID NO: 338 - DNA, 20 bp, Artificial Sequence
  Description of Artificial Sequence: Synthetic oligonucleotide
gtcacctggcaggaggaggc

SEQ ID NO: 339 - DNA, 20 bp, Artificial Sequence
  Description of Artificial Sequence: Synthetic oligonucleotide
ggcaccctgcagggagaaga

SEQ ID NO: 340 - DNA, 20 bp, Artificial Sequence
  Description of Artificial Sequence: Synthetic oligonucleotide
gcaccctgcagggagaagaa

SEQ ID NO: 341 - DNA, 20 bp, Artificial Sequence
  Description of Artificial Sequence: Synthetic oligonucleotide
attctgtcgtgggtaggggc

SEQ ID NO: 342 - DNA, 20 bp, Artificial Sequence
  Description of Artificial Sequence: Synthetic oligonucleotide
ctccattctgtcgtgggtag

SEQ ID NO: 343 - DNA, 20 bp, Artificial Sequence
  Description of Artificial Sequence: Synthetic oligonucleotide
cctcgggctgcaaaggagag

SEQ ID NO: 344 - DNA, 20 bp, Artificial Sequence
  Description of Artificial Sequence: Synthetic oligonucleotide
cgggctgcaaaggagagggg

SEQ ID NO: 345 - DNA, 20 bp, Artificial Sequence
  Description of Artificial Sequence: Synthetic oligonucleotide
gctgacctttccggtatccc

SEQ ID NO: 346 - DNA, 20 bp, Artificial Sequence
  Description of Artificial Sequence: Synthetic oligonucleotide
ctgacctttccggtatccca

SEQ ID NO: 347 - DNA, 20 bp, Artificial Sequence
  Description of Artificial Sequence: Synthetic oligonucleotide
tgttgcactgagatggggca

SEQ ID NO: 348 - DNA, 20 bp, Artificial Sequence
  Description of Artificial Sequence: Synthetic oligonucleotide
ctgttgcactgagatggggc

SEQ ID NO: 349 - DNA, 20 bp, Artificial Sequence
  Description of Artificial Sequence: Synthetic oligonucleotide
gccctgcagcccccagaacc

SEQ ID NO: 350 - DNA, 20 bp, Artificial Sequence
  Description of Artificial Sequence: Synthetic oligonucleotide
ctcacccgcagtgacacaca

SEQ ID NO: 351 - DNA, 20 bp, Artificial Sequence
  Description of Artificial Sequence: Synthetic oligonucleotide
gcagcacccagggcaggacc

SEQ ID NO: 352 - DNA, 20 bp, Artificial Sequence
  Description of Artificial Sequence: Synthetic oligonucleotide
cagcacccagggcaggacca

SEQ ID NO: 353 - DNA, 20 bp, Artificial Sequence
  Description of Artificial Sequence: Synthetic oligonucleotide
gtccctgtggaacagcagca

SEQ ID NO: 354 - DNA, 20 bp, Artificial Sequence
  Description of Artificial Sequence: Synthetic oligonucleotide
gtgggttcaagttcggatgg

SEQ ID NO: 355 - DNA, 20 bp, Artificial Sequence
  Description of Artificial Sequence: Synthetic oligonucleotide
gccccacctgggtctgagct

SEQ ID NO: 356 - DNA, 20 bp, Artificial Sequence
  Description of Artificial Sequence: Synthetic oligonucleotide
ggccccacctgggtctgagc

SEQ ID NO: 357 - DNA, 20 bp, Artificial Sequence
  Description of Artificial Sequence: Synthetic oligonucleotide
ccacctgggtctgagctggg

SEQ ID NO: 358 - DNA, 20 bp, Artificial Sequence
  Description of Artificial Sequence: Synthetic oligonucleotide
aggcctcccaggagccctca

SEQ ID NO: 359 - DNA, 20 bp, Artificial Sequence
  Description of Artificial Sequence: Synthetic oligonucleotide
ctcccaggagccctcaggga

SEQ ID NO: 360 - DNA, 20 bp, Artificial Sequence
  Description of Artificial Sequence: Synthetic oligonucleotide
cccccagctcacagtcacca

SEQ ID NO: 361 - DNA, 20 bp, Artificial Sequence
  Description of Artificial Sequence: Synthetic oligonucleotide
ggtctcaccggtgcttatgt

SEQ ID NO: 362 - DNA, 20 bp, Artificial Sequence
  Description of Artificial Sequence: Synthetic oligonucleotide
tgctgcgccgacataagcac

SEQ ID NO: 363 - DNA, 20 bp, Artificial Sequence
  Description of Artificial Sequence: Synthetic oligonucleotide
ggcagggctgggagagagca

SEQ ID NO: 364 - DNA, 20 bp, Artificial Sequence
  Description of Artificial Sequence: Synthetic oligonucleotide
cgagagcacgagcatgggtg

SEQ ID NO: 365 - DNA, 20 bp, Artificial Sequence
  Description of Artificial Sequence: Synthetic oligonucleotide
gagcacgagcatgggtgagg

SEQ ID NO: 366 - DNA, 20 bp, Artificial Sequence
  Description of Artificial Sequence: Synthetic oligonucleotide
agcacgagcatgggtgagga

SEQ ID NO: 367 - DNA, 20 bp, Artificial Sequence
  Description of Artificial Sequence: Synthetic oligonucleotide
gcacgagcatgggtgaggag

SEQ ID NO: 368 - DNA, 20 bp, Artificial Sequence
  Description of Artificial Sequence: Synthetic oligonucleotide
ctcacccatgctcgtgctct

SEQ ID NO: 369 - DNA, 20 bp, Artificial Sequence
  Description of Artificial Sequence: Synthetic oligonucleotide
ggtgcctgcgcgggggaagg

SEQ ID NO: 370 - DNA, 20 bp, Artificial Sequence
  Description of Artificial Sequence: Synthetic oligonucleotide
gtgcctgcgcgggggaagga

SEQ ID NO: 371 - DNA, 20 bp, Artificial Sequence
  Description of Artificial Sequence: Synthetic oligonucleotide
cttggtgcctgcgcggggga

SEQ ID NO: 372 - DNA, 20 bp, Artificial Sequence
  Description of Artificial Sequence: Synthetic oligonucleotide
ggccccagggccctgccgcc

SEQ ID NO: 373 - DNA, 20 bp, Artificial Sequence
  Description of Artificial Sequence: Synthetic oligonucleotide
tctacgctcaggcaggggag

SEQ ID NO: 374 - DNA, 20 bp, Artificial Sequence
  Description of Artificial Sequence: Synthetic oligonucleotide
ccaccaggacggccccccat

SEQ ID NO: 375 - DNA, 20 bp, Artificial Sequence
  Description of Artificial Sequence: Synthetic oligonucleotide
aggcccaggcggcagggccc

SEQ ID NO: 376 - DNA, 20 bp, Artificial Sequence
  Description of Artificial Sequence: Synthetic oligonucleotide
ggcccaggcggcagggccct

SEQ ID NO: 377 - DNA, 20 bp, Artificial Sequence
  Description of Artificial Sequence: Synthetic oligonucleotide
acgactggccagggcgcctg

SEQ ID NO: 378 - DNA, 20 bp, Artificial Sequence
  Description of Artificial Sequence: Synthetic oligonucleotide
caccgcccagacgactggcc

SEQ ID NO: 379 - DNA, 20 bp, Artificial Sequence
  Description of Artificial Sequence: Synthetic oligonucleotide
ctacaactgggctggcggcc

SEQ ID NO: 380 - DNA, 20 bp, Artificial Sequence
  Description of Artificial Sequence: Synthetic oligonucleotide
cacctacctaagaaccatcc

SEQ ID NO: 381 - DNA, 20 bp, Artificial Sequence
  Description of Artificial Sequence: Synthetic oligonucleotide
ggagtctgagagatggagag

SEQ ID NO: 382 - DNA, 20 bp, Artificial Sequence
  Description of Artificial Sequence: Synthetic oligonucleotide
cagcaaccagacggacaagc

SEQ ID NO: 383 - DNA, 20 bp, Artificial Sequence
  Description of Artificial Sequence: Synthetic oligonucleotide
gtgtcacacaactgcccaac

SEQ ID NO: 384 - DNA, 20 bp, Artificial Sequence
  Description of Artificial Sequence: Synthetic oligonucleotide
agccggccagttccaaaccc

SEQ ID NO: 385 - DNA, 20 bp, Artificial Sequence
  Description of Artificial Sequence: Synthetic oligonucleotide
cagttccaaaccctggtggt

SEQ ID NO: 386 - DNA, 20 bp, Artificial Sequence
  Description of Artificial Sequence: Synthetic oligonucleotide
cggccagttccaaaccctgg

SEQ ID NO: 387 - DNA, 20 bp, Artificial Sequence
  Description of Artificial Sequence: Synthetic oligonucleotide
ggacccagactagcagcacc

SEQ ID NO: 388 - DNA, 20 bp, Artificial Sequence
  Description of Artificial Sequence: Synthetic oligonucleotide
gacgttacctcgtgcggccc

SEQ ID NO: 389 - DNA, 20 bp, Artificial Sequence
  Description of Artificial Sequence: Synthetic oligonucleotide
tccctgcagagaaacacact

SEQ ID NO: 390 - DNA, 20 bp, Artificial Sequence
  Description of Artificial Sequence: Synthetic oligonucleotide
gagactcaccaggggctggc

SEQ ID NO: 391 - DNA, 20 bp, Artificial Sequence
  Description of Artificial Sequence: Synthetic oligonucleotide
cctccttctttgaggagaaa

SEQ ID NO: 392 - DNA, 20 bp, Artificial Sequence
  Description of Artificial Sequence: Synthetic oligonucleotide
ggggttccagggcctgtctg

SEQ ID NO: 393 - DNA, 20 bp, Artificial Sequence
  Description of Artificial Sequence: Synthetic oligonucleotide
ttctctctggaagggcacaa

SEQ ID NO: 394 - DNA, 20 bp, Artificial Sequence
  Description of Artificial Sequence: Synthetic oligonucleotide
ccagtggcgagagaagaccc

SEQ ID NO: 395 - DNA, 20 bp, Artificial Sequence
  Description of Artificial Sequence: Synthetic oligonucleotide
tgcccagccactgaggcctg

SEQ ID NO: 396 - DNA, 20 bp, Artificial Sequence
  Description of Artificial Sequence: Synthetic oligonucleotide
cgactggccagggcgcctgt

SEQ ID NO: 397 - DNA, 20 bp, Artificial Sequence
  Description of Artificial Sequence: Synthetic oligonucleotide
accgcccagacgactggcca

SEQ ID NO: 398 - DNA, 20 bp, Artificial Sequence
  Description of Artificial Sequence: Synthetic oligonucleotide
gtttctgcagccgctttggg

SEQ ID NO: 399 - DNA, 20 bp, Artificial Sequence
  Description of Artificial Sequence: Synthetic oligonucleotide
ttacctggagccacccaaag

SEQ ID NO: 400 - DNA, 20 bp, Artificial Sequence
  Description of Artificial Sequence: Synthetic oligonucleotide
tcactaggtgagcaaaagag

SEQ ID NO: 401 - DNA, 20 bp, Artificial Sequence
  Description of Artificial Sequence: Synthetic oligonucleotide
gcctctccagccaggggctg

SEQ ID NO: 402 - DNA, 20 bp, Artificial Sequence
  Description of Artificial Sequence: Synthetic oligonucleotide
cttggcagcatcagccagac

SEQ ID NO: 403 - DNA, 20 bp, Artificial Sequence
  Description of Artificial Sequence: Synthetic oligonucleotide
ccactgggcgggaaagagaa

SEQ ID NO: 404 - DNA, 20 bp, Artificial Sequence
  Description of Artificial Sequence: Synthetic oligonucleotide
acatactcgaggcctggccc

SEQ ID NO: 405 - DNA, 20 bp, Artificial Sequence
  Description of Artificial Sequence: Synthetic oligonucleotide
cctgcagccccgcgtccagc

SEQ ID NO: 406 - DNA, 20 bp, Artificial Sequence
  Description of Artificial Sequence: Synthetic oligonucleotide
cgcgtccagctggatgagcg

SEQ ID NO: 407 - DNA, 20 bp, Artificial Sequence
  Description of Artificial Sequence: Synthetic oligonucleotide
tgggccaggcctcgagtatg

SEQ ID NO: 408 - DNA, 20 bp, Artificial Sequence
  Description of Artificial Sequence: Synthetic oligonucleotide
gggagttacccagaacagtg

SEQ ID NO: 409 - DNA, 20 bp, Artificial Sequence
  Description of Artificial Sequence: Synthetic oligonucleotide
cctgccccaagtcagcccca

SEQ ID NO: 410 - DNA, 20 bp, Artificial Sequence
  Description of Artificial Sequence: Synthetic oligonucleotide
gccagggccgagtccctgtc

SEQ ID NO: 411 - DNA, 20 bp, Artificial Sequence
  Description of Artificial Sequence: Synthetic oligonucleotide
ccagggccgagtccctgtcc

SEQ ID NO: 412 - DNA, 20 bp, Artificial Sequence
  Description of Artificial Sequence: Synthetic oligonucleotide
gccccagggcccagagtcca

SEQ ID NO: 413 - DNA, 20 bp, Artificial Sequence
  Description of Artificial Sequence: Synthetic oligonucleotide
atgtgagccaggcccaggct

SEQ ID NO: 414 - DNA, 20 bp, Artificial Sequence
  Description of Artificial Sequence: Synthetic oligonucleotide
gaggagtccacttggcagtg

SEQ ID NO: 415 - DNA, 20 bp, Artificial Sequence
  Description of Artificial Sequence: Synthetic oligonucleotide
gagtcactgaaaagagtaga

SEQ ID NO: 416 - DNA, 20 bp, Artificial Sequence
  Description of Artificial Sequence: Synthetic oligonucleotide
ctggacaagaacgctttgtg

SEQ ID NO: 417 - DNA, 20 bp, Artificial Sequence
  Description of Artificial Sequence: Synthetic oligonucleotide
ccatcccagaggagtttctc

SEQ ID NO: 418 - DNA, 20 bp, Artificial Sequence
  Description of Artificial Sequence: Synthetic oligonucleotide
tggcaatgccagctgtacca

SEQ ID NO: 419 - DNA, 20 bp, Artificial Sequence
  Description of Artificial Sequence: Synthetic oligonucleotide
taccagggggagaggcttct

SEQ ID NO: 420 - DNA, 20 bp, Artificial Sequence
  Description of Artificial Sequence: Synthetic oligonucleotide
ggcattgccaaggctgggaa

SEQ ID NO: 421 - DNA, 20 bp, Artificial Sequence
  Description of Artificial Sequence: Synthetic oligonucleotide
ggcacctatggagaaagtac

SEQ ID NO: 422 - DNA, 20 bp, Artificial Sequence
  Description of Artificial Sequence: Synthetic oligonucleotide
agacaggtgagccagggaca

SEQ ID NO: 423 - DNA, 20 bp, Artificial Sequence
  Description of Artificial Sequence: Synthetic oligonucleotide
ggctcacctgtcttctccaa

SEQ ID NO: 424 - DNA, 20 bp, Artificial Sequence
  Description of Artificial Sequence: Synthetic oligonucleotide
gtcgccactgtgagaagaga

SEQ ID NO: 425 - DNA, 20 bp, Artificial Sequence
  Description of Artificial Sequence: Synthetic oligonucleotide
gcaggctcagagcaagatag

SEQ ID NO: 426 - DNA, 20 bp, Artificial Sequence
  Description of Artificial Sequence: Synthetic oligonucleotide
gctggagcaagaaccggagc

SEQ ID NO: 427 - DNA, 20 bp, Artificial Sequence
  Description of Artificial Sequence: Synthetic oligonucleotide
actcacctttgcagaagaca

SEQ ID NO: 428 - DNA, 20 bp, Artificial Sequence
  Description of Artificial Sequence: Synthetic oligonucleotide
cactcacctttgcagaagac

SEQ ID NO: 429 - DNA, 20 bp, Artificial Sequence
  Description of Artificial Sequence: Synthetic oligonucleotide
agggccaggtcctggtagcc

SEQ ID NO: 430 - DNA, 20 bp, Artificial Sequence
  Description of Artificial Sequence: Synthetic oligonucleotide
ggcccagcctgctgtggtac

SEQ ID NO: 431 - DNA, 20 bp, Artificial Sequence
  Description of Artificial Sequence: Synthetic oligonucleotide
gcttcggcaggctgacagcc

SEQ ID NO: 432 - DNA, 20 bp, Artificial Sequence
  Description of Artificial Sequence: Synthetic oligonucleotide
tatccaaggactgagggcca

SEQ ID NO: 433 - DNA, 20 bp, Artificial Sequence
  Description of Artificial Sequence: Synthetic oligonucleotide
ggaacccagatttatgtaat

SEQ ID NO: 434 - DNA, 20 bp, Artificial Sequence
  Description of Artificial Sequence: Synthetic oligonucleotide
gctcaccaattacataaatc

SEQ ID NO: 435 - DNA, 20 bp, Artificial Sequence
  Description of Artificial Sequence: Synthetic oligonucleotide
ctcaccaattacataaatct

SEQ ID NO: 436 - DNA, 20 bp, Artificial Sequence
  Description of Artificial Sequence: Synthetic oligonucleotide
ctcagctgaacctggctacc

SEQ ID NO: 437 - DNA, 20 bp, Artificial Sequence
  Description of Artificial Sequence: Synthetic oligonucleotide
ggcgtctcaaacaggtatct

SEQ ID NO: 438 - DNA, 20 bp, Artificial Sequence
  Description of Artificial Sequence: Synthetic oligonucleotide
caaagcctgaagagaaatcc

SEQ ID NO: 439 - DNA, 20 bp, Artificial Sequence
  Description of Artificial Sequence: Synthetic oligonucleotide
agagcctgaaggagaagtct

SEQ ID NO: 440 - DNA, 20 bp, Artificial Sequence
  Description of Artificial Sequence: Synthetic oligonucleotide
tcccagtaccgggaaggcga

SEQ ID NO: 441 - DNA, 20 bp, Artificial Sequence
  Description of Artificial Sequence: Synthetic oligonucleotide
ggttcctgtggagcacaggg

SEQ ID NO: 442 - DNA, 20 bp, Artificial Sequence
  Description of Artificial Sequence: Synthetic oligonucleotide
tggggttcctgtggagcaca

SEQ ID NO: 443 - DNA, 20 bp, Artificial Sequence
  Description of Artificial Sequence: Synthetic oligonucleotide
tcatttcctagatgggagac

SEQ ID NO: 444 - DNA, 20 bp, Artificial Sequence
  Description of Artificial Sequence: Synthetic oligonucleotide
ttcctagatgggagacaggc

SEQ ID NO: 445 - DNA, 20 bp, Artificial Sequence
  Description of Artificial Sequence: Synthetic oligonucleotide
ccaggtgtctgaggaggaag

SEQ ID NO: 446 - DNA, 20 bp, Artificial Sequence
  Description of Artificial Sequence: Synthetic oligonucleotide
gtgtctgaggaggaagggga

SEQ ID NO: 447 - DNA, 20 bp, Artificial Sequence
  Description of Artificial Sequence: Synthetic oligonucleotide
tagtcctgggtggggtaggg

SEQ ID NO: 448 - DNA, 20 bp, Artificial Sequence
  Description of Artificial Sequence: Synthetic oligonucleotide
agtcctgggtggggtagggt

SEQ ID NO: 449 - DNA, 20 bp, Artificial Sequence
  Description of Artificial Sequence: Synthetic oligonucleotide
cattacctcatagtaggcaa

SEQ ID NO: 450 - DNA, 20 bp, Artificial Sequence
  Description of Artificial Sequence: Synthetic oligonucleotide
ccattacctcatagtaggca

SEQ ID NO: 451 - DNA, 20 bp, Artificial Sequence
  Description of Artificial Sequence: Synthetic oligonucleotide
acagatctgagcagataaca

SEQ ID NO: 452 - DNA, 20 bp, Artificial Sequence
  Description of Artificial Sequence: Synthetic oligonucleotide
tcctacccactggttgccct

SEQ ID NO: 453 - DNA, 20 bp, Artificial Sequence
  Description of Artificial Sequence: Synthetic oligonucleotide
aggtgcagtacctgaaggac

SEQ ID NO: 454 - DNA, 20 bp, Artificial Sequence
  Description of Artificial Sequence: Synthetic oligonucleotide
caggcagctggcgggcgcca

SEQ ID NO: 455 - DNA, 20 bp, Artificial Sequence
  Description of Artificial Sequence: Synthetic oligonucleotide
gacttccagggctccttctg

SEQ ID NO: 456 - DNA, 20 bp, Artificial Sequence
  Description of Artificial Sequence: Synthetic oligonucleotide
catccagatacattttgtca

SEQ ID NO: 457 - DNA, 20 bp, Artificial Sequence
  Description of Artificial Sequence: Synthetic oligonucleotide
acctgccaaacacagacagt

SEQ ID NO: 458 - DNA, 20 bp, Artificial Sequence
  Description of Artificial Sequence: Synthetic oligonucleotide
cgtgcagatgcaatggtcca

SEQ ID NO: 459 - DNA, 20 bp, Artificial Sequence
  Description of Artificial Sequence: Synthetic oligonucleotide
tgtaactgtaacaaaacata

SEQ ID NO: 460 - DNA, 20 bp, Artificial Sequence
  Description of Artificial Sequence: Synthetic oligonucleotide
acttaccaccgaccatgcat

SEQ ID NO: 461 - DNA, 20 bp, Artificial Sequence
  Description of Artificial Sequence: Synthetic oligonucleotide
cttaccaaaaaccttgactg

SEQ ID NO: 462 - DNA, 20 bp, Artificial Sequence
  Description of Artificial Sequence: Synthetic oligonucleotide
ccagtccaaatcttcgatga

SEQ ID NO: 463 - DNA, 20 bp, Artificial Sequence
  Description of Artificial Sequence: Synthetic oligonucleotide
cagtccaaatcttcgatgat

SEQ ID NO: 464 - DNA, 20 bp, Artificial Sequence
  Description of Artificial Sequence: Synthetic oligonucleotide
aaaccatgtgatatttgctt

SEQ ID NO: 465 - DNA, 20 bp, Artificial Sequence
  Description of Artificial Sequence: Synthetic oligonucleotide
atgttccacactttatttcc

SEQ ID NO: 466 - DNA, 20 bp, Artificial Sequence
  Description of Artificial Sequence: Synthetic oligonucleotide
tcacgttgaggagtggtgtt

SEQ ID NO: 467 - DNA, 20 bp, Artificial Sequence
  Description of Artificial Sequence: Synthetic oligonucleotide
cattgtctagggatataaag

SEQ ID NO: 468 - DNA, 20 bp, Artificial Sequence
  Description of Artificial Sequence: Synthetic oligonucleotide
acattgtctagggatataaa

SEQ ID NO: 469 - DNA, 20 bp, Artificial Sequence
  Description of Artificial Sequence: Synthetic oligonucleotide
gacattgtctagggatataa

SEQ ID NO: 470 - DNA, 20 bp, Artificial Sequence
  Description of Artificial Sequence: Synthetic oligonucleotide
tggccaggacattccatctt

SEQ ID NO: 471 - DNA, 20 bp, Artificial Sequence
  Description of Artificial Sequence: Synthetic oligonucleotide
ccattctaggaacaaaatat

SEQ ID NO: 472 - DNA, 20 bp, Artificial Sequence
  Description of Artificial Sequence: Synthetic oligonucleotide
gagcttccaagtcttctcca

SEQ ID NO: 473 - DNA, 20 bp, Artificial Sequence
  Description of Artificial Sequence: Synthetic oligonucleotide
tccccgaaaaggtcgaattt

SEQ ID NO: 474 - DNA, 20 bp, Artificial Sequence
  Description of Artificial Sequence: Synthetic oligonucleotide
atgaagaacagtcacaggac

SEQ ID NO: 475 - DNA, 20 bp, Artificial Sequence
  Description of Artificial Sequence: Synthetic oligonucleotide
gatttcgtctgtaggcacaa

SEQ ID NO: 476 - DNA, 20 bp, Artificial Sequence
  Description of Artificial Sequence: Synthetic oligonucleotide
taaacttacctgaaacagcc

SEQ ID NO: 477 - DNA, 20 bp, Artificial Sequence
  Description of Artificial Sequence: Synthetic oligonucleotide
attcagacagtgccttcatg

SEQ ID NO: 478 - DNA, 20 bp, Artificial Sequence
  Description of Artificial Sequence: Synthetic oligonucleotide
gttgcactcgattgggacag

SEQ ID NO: 479 - DNA, 20 bp, Artificial Sequence
  Description of Artificial Sequence: Synthetic oligonucleotide
ttatttcaagccctgattga

SEQ ID NO: 480 - DNA, 20 bp, Artificial Sequence
  Description of Artificial Sequence: Synthetic oligonucleotide
ttacctgtgtaacttttata

SEQ ID NO: 481 - DNA, 20 bp, Artificial Sequence
  Description of Artificial Sequence: Synthetic oligonucleotide
attgttcctggaatttgggg

SEQ ID NO: 482 - DNA, 20 bp, Artificial Sequence
  Description of Artificial Sequence: Synthetic oligonucleotide
attatacctgccatgccgta

SEQ ID NO: 483 - DNA, 20 bp, Artificial Sequence
  Description of Artificial Sequence: Synthetic oligonucleotide
gttcctggaatttggggagg

SEQ ID NO: 484 - DNA, 20 bp, Artificial Sequence
  Description of Artificial Sequence: Synthetic oligonucleotide
ctgccatgccgtaaggcaag

SEQ ID NO: 485 - DNA, 20 bp, Artificial Sequence
  Description of Artificial Sequence: Synthetic oligonucleotide
tctacctttggtgaacccgt

SEQ ID NO: 486 - DNA, 20 bp, Artificial Sequence
  Description of Artificial Sequence: Synthetic oligonucleotide
cttaccttagctccttctaa

SEQ ID NO: 487 - DNA, 20 bp, Artificial Sequence
  Description of Artificial Sequence: Synthetic oligonucleotide
gggatgtcgactcctagggg

SEQ ID NO: 488 - DNA, 20 bp, Artificial Sequence
  Description of Artificial Sequence: Synthetic oligonucleotide
cgagggcaccatgcttcaag

SEQ ID NO: 489 - DNA, 20 bp, Artificial Sequence
  Description of Artificial Sequence: Synthetic oligonucleotide
aaactcactttatgctaggg

SEQ ID NO: 490 - DNA, 20 bp, Artificial Sequence
  Description of Artificial Sequence: Synthetic oligonucleotide
ctcactttatgctagggagg

SEQ ID NO: 491 - DNA, 20 bp, Artificial Sequence
  Description of Artificial Sequence: Synthetic oligonucleotide
cttcacctgcatttaaagaa

SEQ ID NO: 492 - DNA, 20 bp, Artificial Sequence
  Description of Artificial Sequence: Synthetic oligonucleotide
ccaccagattagctctggcc

SEQ ID NO: 493 - DNA, 20 bp, Artificial Sequence
  Description of Artificial Sequence: Synthetic oligonucleotide
ctacctttggtgaacccgtt

SEQ ID NO: 494 - DNA, 20 bp, Artificial Sequence
  Description of Artificial Sequence: Synthetic oligonucleotide
atgttccagatgtccagata

SEQ ID NO: 495 - DNA, 20 bp, Artificial Sequence
  Description of Artificial Sequence: Synthetic oligonucleotide
tgttccagatgtccagatat

SEQ ID NO: 496 - DNA, 20 bp, Artificial Sequence
  Description of Artificial Sequence: Synthetic oligonucleotide
agatagacaaacaagttgga

SEQ ID NO: 497 - DNA, 20 bp, Artificial Sequence
  Description of Artificial Sequence: Synthetic oligonucleotide
agcttgcaccaagtcacatg

SEQ ID NO: 498 - DNA, 20 bp, Artificial Sequence
  Description of Artificial Sequence: Synthetic oligonucleotide
acccaccttggtgccttctc

SEQ ID NO: 499 - DNA, 20 bp, Artificial Sequence
  Description of Artificial Sequence: Synthetic oligonucleotide
actcacgctggatagcctcc

SEQ ID NO: 500 - DNA, 20 bp, Artificial Sequence
  Description of Artificial Sequence: Synthetic oligonucleotide
tggagtacctgaggaatatc

SEQ ID NO: 501 - DNA, 20 bp, Artificial Sequence
  Description of Artificial Sequence: Synthetic oligonucleotide
ttaccccacttaactatctt

SEQ ID NO: 502 - DNA, 20 bp, Artificial Sequence
  Description of Artificial Sequence: Synthetic oligonucleotide
tcgatctatgaaaaagacag

SEQ ID NO: 503 - DNA, 18 bp, Artificial Sequence
  Description of Artificial Sequence: Synthetic oligonucleotide
taccccacttaactatct

SEQ ID NO: 504 - DNA, 20 bp, Artificial Sequence
  Description of Artificial Sequence: Synthetic oligonucleotide
actcacgctggatagcctcc

SEQ ID NO: 505 - DNA, 20 bp, Artificial Sequence
  Description of Artificial Sequence: Synthetic oligonucleotide
ctcaggtactccaaagattc

SEQ ID NO: 506 - DNA, 20 bp, Artificial Sequence
  Description of Artificial Sequence: Synthetic oligonucleotide
cttaccccacttaactatct

SEQ ID NO: 507 - DNA, 20 bp, Artificial Sequence
  Description of Artificial Sequence: Synthetic oligonucleotide
catttgccagacagaacctc

SEQ ID NO: 508 - DNA, 20 bp, Artificial Sequence
  Description of Artificial Sequence: Synthetic oligonucleotide
aaacaagaccaaaaggctaa

SEQ ID NO: 509 - DNA, 20 bp, Artificial Sequence
  Description of Artificial Sequence: Synthetic oligonucleotide
gtaagccaagaaagaaatcc

SEQ ID NO: 510 - DNA, 20 bp, Artificial Sequence
  Description of Artificial Sequence: Synthetic oligonucleotide
gcttcagattctgaatgagc

SEQ ID NO: 511 - DNA, 20 bp, Artificial Sequence
  Description of Artificial Sequence: Synthetic oligonucleotide
ttaaaacaaaatgaaatgaa

SEQ ID NO: 512 - DNA, 20 bp, Artificial Sequence
  Description of Artificial Sequence: Synthetic oligonucleotide
gttcctcagcttccttcaga

SEQ ID NO: 513 - DNA, 20 bp, Artificial Sequence
  Description of Artificial Sequence: Synthetic oligonucleotide
caaagagcaagagattctga

SEQ ID NO: 514 - DNA, 20 bp, Artificial Sequence
  Description of Artificial Sequence: Synthetic oligonucleotide
aaagagcaagagattctgaa

SEQ ID NO: 515 - DNA, 20 bp, Artificial Sequence
  Description of Artificial Sequence: Synthetic oligonucleotide
acacagcactatctgaaacc

SEQ ID NO: 516 - DNA, 20 bp, Artificial Sequence
  Description of Artificial Sequence: Synthetic oligonucleotide
cacccagaaaacaacacagc

SEQ ID NO: 517 - DNA, 20 bp, Artificial Sequence
  Description of Artificial Sequence: Synthetic oligonucleotide
taccaagttgaaatgaatca

SEQ ID NO: 518 - DNA, 20 bp, Artificial Sequence
  Description of Artificial Sequence: Synthetic oligonucleotide
atgaatcaagggcagtccca

SEQ ID NO: 519 - DNA, 20 bp, Artificial Sequence
  Description of Artificial Sequence: Synthetic oligonucleotide
agggcagtcccaaggtacag

SEQ ID NO: 520 - DNA, 20 bp, Artificial Sequence
  Description of Artificial Sequence: Synthetic oligonucleotide
gttccaaaaaccctcacacc

SEQ ID NO: 521 - DNA, 20 bp, Artificial Sequence
  Description of Artificial Sequence: Synthetic oligonucleotide
gaaacagcacttgaatcaac

SEQ ID NO: 522 - DNA, 20 bp, Artificial Sequence
  Description of Artificial Sequence: Synthetic oligonucleotide
attacaaataaagaataaag

SEQ ID NO: 523 - DNA, 20 bp, Artificial Sequence
  Description of Artificial Sequence: Synthetic oligonucleotide
taatgtccaaatgggactgg

SEQ ID NO: 524 - DNA, 20 bp, Artificial Sequence
  Description of Artificial Sequence: Synthetic oligonucleotide
caaagcaagatcttcttcac

SEQ ID NO: 525 - DNA, 20 bp, Artificial Sequence
  Description of Artificial Sequence: Synthetic oligonucleotide
acaacaagcttcagttctac

SEQ ID NO: 526 - DNA, 20 bp, Artificial Sequence
  Description of Artificial Sequence: Synthetic oligonucleotide
ctgcgcaacttgctcagcaa

SEQ ID NO: 527 - DNA, 20 bp, Artificial Sequence
  Description of Artificial Sequence: Synthetic oligonucleotide
cactcagacccctccccaga

SEQ ID NO: 528 - DNA, 20 bp, Artificial Sequence
  Description of Artificial Sequence: Synthetic oligonucleotide
tttttccatgttttgttttc

SEQ ID NO: 529 - DNA, 20 bp, Artificial Sequence
  Description of Artificial Sequence: Synthetic oligonucleotide
ttacctacacatctgcaaga

SEQ ID NO: 530 - DNA, 20 bp, Artificial Sequence
  Description of Artificial Sequence: Synthetic oligonucleotide
acacttacccacttagcaat

SEQ ID NO: 531 - DNA, 20 bp, Artificial Sequence
  Description of Artificial Sequence: Synthetic oligonucleotide
catgcagaatggcagcacat

SEQ ID NO: 532 - DNA, 20 bp, Artificial Sequence
  Description of Artificial Sequence: Synthetic oligonucleotide
aagctcaggaggagaaaaaa

SEQ ID NO: 533 - DNA, 20 bp, Artificial Sequence
  Description of Artificial Sequence: Synthetic oligonucleotide
cgcaagccaggctaaacagt

SEQ ID NO: 534 - DNA, 20 bp, Artificial Sequence
  Description of Artificial Sequence: Synthetic oligonucleotide
ttctccccagtctcagccga

SEQ ID NO: 535 - DNA, 20 bp, Artificial Sequence
  Description of Artificial Sequence: Synthetic oligonucleotide
tggtcaggaaaagcagccat

SEQ ID NO: 536 - DNA, 20 bp, Artificial Sequence
  Description of Artificial Sequence: Synthetic oligonucleotide
ctagtccagggtgtggcttc

SEQ ID NO: 537 - DNA, 20 bp, Artificial Sequence
  Description of Artificial Sequence: Synthetic oligonucleotide
ccccaaaatcaacatggcag

SEQ ID NO: 538 - DNA, 20 bp, Artificial Sequence
  Description of Artificial Sequence: Synthetic oligonucleotide
tgtgatccagcagccttctt

SEQ ID NO: 539 - DNA, 20 bp, Artificial Sequence
  Description of Artificial Sequence: Synthetic oligonucleotide
gaccagatcaaggccataag

SEQ ID NO: 540 - DNA, 20 bp, Artificial Sequence
  Description of Artificial Sequence: Synthetic oligonucleotide
caagacaagaaaagcatgaa

SEQ ID NO: 541 - DNA, 20 bp, Artificial Sequence
  Description of Artificial Sequence: Synthetic oligonucleotide
ctgaacagggactgttagga

SEQ ID NO: 542 - DNA, 20 bp, Artificial Sequence
  Description of Artificial Sequence: Synthetic oligonucleotide
ccagagctcagagtggcaac

SEQ ID NO: 543 - DNA, 20 bp, Artificial Sequence
  Description of Artificial Sequence: Synthetic oligonucleotide
ttgctgcagacgccccgtga

SEQ ID NO: 544 - DNA, 20 bp, Artificial Sequence
  Description of Artificial Sequence: Synthetic oligonucleotide
ctgcagacgccccgtgacgg

SEQ ID NO: 545 - DNA, 20 bp, Artificial Sequence
  Description of Artificial Sequence: Synthetic oligonucleotide
cgacaagcagtgcctttgct

SEQ ID NO: 546 - DNA, 20 bp, Artificial Sequence
  Description of Artificial Sequence: Synthetic oligonucleotide
gcccagaacgtgattgacta

SEQ ID NO: 547 - DNA, 20 bp, Artificial Sequence
  Description of Artificial Sequence: Synthetic oligonucleotide
tgtgccaggggtgttatgac

SEQ ID NO: 548 - DNA, 20 bp, Artificial Sequence
  Description of Artificial Sequence: Synthetic oligonucleotide
cagatccagtctgatggcag

SEQ ID NO: 549 - DNA, 20 bp, Artificial Sequence
  Description of Artificial Sequence: Synthetic oligonucleotide
tgtacacgatggtcagccat

SEQ ID NO: 550 - DNA, 20 bp, Artificial Sequence
  Description of Artificial Sequence: Synthetic oligonucleotide
ttttaccttggggctctgac

SEQ ID NO: 551 - DNA, 20 bp, Artificial Sequence
  Description of Artificial Sequence: Synthetic oligonucleotide
agccccaaggtaaaaaggcc

SEQ ID NO: 552 - DNA, 20 bp, Artificial Sequence
  Description of Artificial Sequence: Synthetic oligonucleotide
gagccccaaggtaaaaaggc

SEQ ID NO: 553 - DNA, 20 bp, Artificial Sequence
  Description of Artificial Sequence: Synthetic oligonucleotide
cagctcacagtgtgccacca

SEQ ID NO: 554 - DNA, 20 bp, Artificial Sequence
  Description of Artificial Sequence: Synthetic oligonucleotide
tatgaccagatggacctggc

SEQ ID NO: 555 - DNA, 20 bp, Artificial Sequence
  Description of Artificial Sequence: Synthetic oligonucleotide
actggaccagtatgtcttcc

SEQ ID NO: 556 - DNA, 20 bp, Artificial Sequence
  Description of Artificial Sequence: Synthetic oligonucleotide
tgtcttccaggactcccagc

SEQ ID NO: 557 - DNA, 20 bp, Artificial Sequence
  Description of Artificial Sequence: Synthetic oligonucleotide
ttcaaccaggagccagcctc

SEQ ID NO: 558 - DNA, 20 bp, Artificial Sequence
  Description of Artificial Sequence: Synthetic oligonucleotide
gaccagattcccagtatgtt

SEQ ID NO: 559 - DNA, 20 bp, Artificial Sequence
  Description of Artificial Sequence: Synthetic oligonucleotide
taacatactgggaatctggt

SEQ ID NO: 560 - DNA, 20 bp, Artificial Sequence
  Description of Artificial Sequence: Synthetic oligonucleotide
aaaggcactgcaagagacaa

SEQ ID NO: 561 - DNA, 20 bp, Artificial Sequence
  Description of Artificial Sequence: Synthetic oligonucleotide
ctctggcaaatctctgaggc

SEQ ID NO: 562 - DNA, 20 bp, Artificial Sequence
  Description of Artificial Sequence: Synthetic oligonucleotide
agccaagtaccccctcccag

SEQ ID NO: 563 - DNA, 20 bp, Artificial Sequence
  Description of Artificial Sequence: Synthetic oligonucleotide
acctcccgagcaaacatgac

SEQ ID NO: 564 - DNA, 20 bp, Artificial Sequence
  Description of Artificial Sequence: Synthetic oligonucleotide
ccttacctgtcatgtttgct

SEQ ID NO: 565 - DNA, 20 bp, Artificial Sequence
  Description of Artificial Sequence: Synthetic oligonucleotide
tgctctggagatggagaagc

SEQ ID NO: 566 - DNA, 20 bp, Artificial Sequence
  Description of Artificial Sequence: Synthetic oligonucleotide
cccacccaatgcccggcagc

SEQ ID NO: 567 - DNA, 20 bp, Artificial Sequence
  Description of Artificial Sequence: Synthetic oligonucleotide
aggccattttggaagcttgt

SEQ ID NO: 568 - DNA, 20 bp, Artificial Sequence
  Description of Artificial Sequence: Synthetic oligonucleotide
accggctctgcaaaggccag

SEQ ID NO: 569 - DNA, 20 bp, Artificial Sequence
  Description of Artificial Sequence: Synthetic oligonucleotide
tggtgcaggccaggctggag

SEQ ID NO: 570 - DNA, 20 bp, Artificial Sequence
  Description of Artificial Sequence: Synthetic oligonucleotide
gaacggcagctggcccaagg

SEQ ID NO: 571 - DNA, 20 bp, Artificial Sequence
  Description of Artificial Sequence: Synthetic oligonucleotide
ggcccaaggaggcctggctg

SEQ ID NO: 572 - DNA, 20 bp, Artificial Sequence
  Description of Artificial Sequence: Synthetic oligonucleotide
gacacgagtgattgctgtgc

SEQ ID NO: 573 - DNA, 20 bp, Artificial Sequence
  Description of Artificial Sequence: Synthetic oligonucleotide
ctggtcagggcaagagctat

SEQ ID NO: 574 - DNA, 20 bp, Artificial Sequence
  Description of Artificial Sequence: Synthetic oligonucleotide
gggcccacagccactcgtgg

SEQ ID NO: 575 - DNA, 20 bp, Artificial Sequence
  Description of Artificial Sequence: Synthetic oligonucleotide
ttccagaagaagctgctccg

SEQ ID NO: 576 - DNA, 20 bp, Artificial Sequence
  Description of Artificial Sequence: Synthetic oligonucleotide
cctggtccagagcctgagca

SEQ ID NO: 577 - DNA, 20 bp, Artificial Sequence
  Description of Artificial Sequence: Synthetic oligonucleotide
cagacatcaaagtaccctac

SEQ ID NO: 578 - DNA, 20 bp, Artificial Sequence
  Description of Artificial Sequence: Synthetic oligonucleotide
acatcaaagtaccctacagg

SEQ ID NO: 579 - DNA, 20 bp, Artificial Sequence
  Description of Artificial Sequence: Synthetic oligonucleotide
cgcccaggtcctcacgtctg

SEQ ID NO: 580 - DNA, 20 bp, Artificial Sequence
  Description of Artificial Sequence: Synthetic oligonucleotide
cttagtccaacacccaccgc

SEQ ID NO: 581 - DNA, 20 bp, Artificial Sequence
  Description of Artificial Sequence: Synthetic oligonucleotide
cctcctgcaatgcttcctgg

SEQ ID NO: 582 - DNA, 20 bp, Artificial Sequence
  Description of Artificial Sequence: Synthetic oligonucleotide
gagccagccacagggccccc

SEQ ID NO: 583 - DNA, 20 bp, Artificial Sequence
  Description of Artificial Sequence: Synthetic oligonucleotide
ggaagcagaaggtgcttgcg

SEQ ID NO: 584 - DNA, 20 bp, Artificial Sequence
  Description of Artificial Sequence: Synthetic oligonucleotide
ggctgcagccggggacactg

SEQ ID NO: 585 - DNA, 20 bp, Artificial Sequence
  Description of Artificial Sequence: Synthetic oligonucleotide
ctgccaaattccagcctcct

SEQ ID NO: 586 - DNA, 20 bp, Artificial Sequence
  Description of Artificial Sequence: Synthetic oligonucleotide
ggcgggccaagacttctccc

SEQ ID NO: 587 - DNA, 20 bp, Artificial Sequence
  Description of Artificial Sequence: Synthetic oligonucleotide
agactcagaggtgagaggag

SEQ ID NO: 588 - DNA, 20 bp, Artificial Sequence
  Description of Artificial Sequence: Synthetic oligonucleotide
agcctaggaggcaaagagca

SEQ ID NO: 589 - DNA, 20 bp, Artificial Sequence
  Description of Artificial Sequence: Synthetic oligonucleotide
cccccaggctttccccaaac

SEQ ID NO: 590 - DNA, 20 bp, Artificial Sequence
  Description of Artificial Sequence: Synthetic oligonucleotide
tcactccagatgctgcaggg

SEQ ID NO: 591 - DNA, 20 bp, Artificial Sequence
  Description of Artificial Sequence: Synthetic oligonucleotide
aggctgcaggtggaatcaga

SEQ ID NO: 592 - DNA, 20 bp, Artificial Sequence
  Description of Artificial Sequence: Synthetic oligonucleotide
cttcccccagctgaagtcct

SEQ ID NO: 593 - DNA, 20 bp, Artificial Sequence
  Description of Artificial Sequence: Synthetic oligonucleotide
cactcacttgagggtttcca

SEQ ID NO: 594 - DNA, 20 bp, Artificial Sequence
  Description of Artificial Sequence: Synthetic oligonucleotide
cagactgcggggacacagtg

SEQ ID NO: 595 - DNA, 20 bp, Artificial Sequence
  Description of Artificial Sequence: Synthetic oligonucleotide
ccactcaccttagcctgagc

SEQ ID NO: 596 - DNA, 20 bp, Artificial Sequence
  Description of Artificial Sequence: Synthetic oligonucleotide
cactcaccttagcctgagca

SEQ ID NO: 597 - DNA, 20 bp, Artificial Sequence
  Description of Artificial Sequence: Synthetic oligonucleotide
gtacaagctgtcggaaacag

SEQ ID NO: 598 - DNA, 20 bp, Artificial Sequence
  Description of Artificial Sequence: Synthetic oligonucleotide
acactcactccatcacccgg

SEQ ID NO: 599 - DNA, 20 bp, Artificial Sequence
  Description of Artificial Sequence: Synthetic oligonucleotide
cactcactccatcacccgga

SEQ ID NO: 600 - DNA, 20 bp, Artificial Sequence
  Description of Artificial Sequence: Synthetic oligonucleotide
cgtccagtacaacaagttca

SEQ ID NO: 601 - DNA, 20 bp, Artificial Sequence
  Description of Artificial Sequence: Synthetic oligonucleotide
ccacatcctgcaagggggga

SEQ ID NO: 602 - DNA, 20 bp, Artificial Sequence
  Description of Artificial Sequence: Synthetic oligonucleotide
cacatcctgcaaggggggat

SEQ ID NO: 603 - DNA, 20 bp, Artificial Sequence
  Description of Artificial Sequence: Synthetic oligonucleotide
tgggcgtccacatcctgcaa

SEQ ID NO: 604 - DNA, 20 bp, Artificial Sequence
  Description of Artificial Sequence: Synthetic oligonucleotide
gggcgtccacatcctgcaag

SEQ ID NO: 605 - DNA, 20 bp, Artificial Sequence
  Description of Artificial Sequence: Synthetic oligonucleotide
ggcgtccacatcctgcaagg

SEQ ID NO: 606 - DNA, 20 bp, Artificial Sequence
  Description of Artificial Sequence: Synthetic oligonucleotide
gcgtccacatcctgcaaggg

SEQ ID NO: 607 - DNA, 20 bp, Artificial Sequence
  Description of Artificial Sequence: Synthetic oligonucleotide
gcccaaggtaagagcttccc

SEQ ID NO: 608 - DNA, 20 bp, Artificial Sequence
  Description of Artificial Sequence: Synthetic oligonucleotide
gctcttaccttgggcagcca

SEQ ID NO: 609 - DNA, 20 bp, Artificial Sequence
  Description of Artificial Sequence: Synthetic oligonucleotide
agctcttaccttgggcagcc

SEQ ID NO: 610 - DNA, 20 bp, Artificial Sequence
  Description of Artificial Sequence: Synthetic oligonucleotide
tgcacctctggggaggacct

SEQ ID NO: 611 - DNA, 20 bp, Artificial Sequence
  Description of Artificial Sequence: Synthetic oligonucleotide
ctgcacctctggggaggacc

SEQ ID NO: 612 - DNA, 20 bp, Artificial Sequence
  Description of Artificial Sequence: Synthetic oligonucleotide
cgcctgcagctgtcggacac

SEQ ID NO: 613 - DNA, 20 bp, Artificial Sequence
  Description of Artificial Sequence: Synthetic oligonucleotide
cacctgccaggccatcacgg

SEQ ID NO: 614 - DNA, 20 bp, Artificial Sequence
  Description of Artificial Sequence: Synthetic oligonucleotide
ccctacctgtcaccaggacc

SEQ ID NO: 615 - DNA, 20 bp, Artificial Sequence
  Description of Artificial Sequence: Synthetic oligonucleotide
cctacctgtcaccaggacca

SEQ ID NO: 616 - DNA, 20 bp, Artificial Sequence
  Description of Artificial Sequence: Synthetic oligonucleotide
cctctgagaaggaaaaaaga

SEQ ID NO: 617 - DNA, 20 bp, Artificial Sequence
  Description of Artificial Sequence: Synthetic oligonucleotide
cagaggaacagtcccaagga

SEQ ID NO: 618 - DNA, 20 bp, Artificial Sequence
  Description of Artificial Sequence: Synthetic oligonucleotide
cactcacctgcccacagcag

SEQ ID NO: 619 - DNA, 20 bp, Artificial Sequence
  Description of Artificial Sequence: Synthetic oligonucleotide
ccactcacctgcccacagca

SEQ ID NO: 620 - DNA, 20 bp, Artificial Sequence
  Description of Artificial Sequence: Synthetic oligonucleotide
gccactcacctgcccacagc

SEQ ID NO: 621 - DNA, 20 bp, Artificial Sequence
  Description of Artificial Sequence: Synthetic oligonucleotide
agggcccctgtggggaaacg

SEQ ID NO: 622 - DNA, 20 bp, Artificial Sequence
  Description of Artificial Sequence: Synthetic oligonucleotide
gggcccctgtggggaaacga

SEQ ID NO: 623 - DNA, 20 bp, Artificial Sequence
  Description of Artificial Sequence: Synthetic oligonucleotide
gcaagtgcaggagtcagtga

SEQ ID NO: 624 - DNA, 20 bp, Artificial Sequence
  Description of Artificial Sequence: Synthetic oligonucleotide
cggaaccagtaaccatgaac

SEQ ID NO: 625 - DNA, 20 bp, Artificial Sequence
  Description of Artificial Sequence: Synthetic oligonucleotide
ggaaccagtaaccatgaact

SEQ ID NO: 626 - DNA, 20 bp, Artificial Sequence
  Description of Artificial Sequence: Synthetic oligonucleotide
gaaccagtaaccatgaactg

SEQ ID NO: 627 - DNA, 20 bp, Artificial Sequence
  Description of Artificial Sequence: Synthetic oligonucleotide
gctagatcaagaagtacagg

SEQ ID NO: 628 - DNA, 20 bp, Artificial Sequence
  Description of Artificial Sequence: Synthetic oligonucleotide
agaagtacaggaggagactc

SEQ ID NO: 629 - DNA, 20 bp, Artificial Sequence
  Description of Artificial Sequence: Synthetic oligonucleotide
caagtctagtgaggagaaag

SEQ ID NO: 630 - DNA, 20 bp, Artificial Sequence
  Description of Artificial Sequence: Synthetic oligonucleotide
aagtctagtgaggagaaaga

SEQ ID NO: 631 - DNA, 20 bp, Artificial Sequence
  Description of Artificial Sequence: Synthetic oligonucleotide
agtctagtgaggagaaagag

SEQ ID NO: 632 - DNA, 20 bp, Artificial Sequence
  Description of Artificial Sequence: Synthetic oligonucleotide
acaggcccaggacacagagc

SEQ ID NO: 633 - DNA, 20 bp, Artificial Sequence
  Description of Artificial Sequence: Synthetic oligonucleotide
acctgtcaggtgaagttcgc

SEQ ID NO: 634 - DNA, 20 bp, Artificial Sequence
  Description of Artificial Sequence: Synthetic oligonucleotide
acttacaggtgacgttgagc

SEQ ID NO: 635 - DNA, 20 bp, Artificial Sequence
  Description of Artificial Sequence: Synthetic oligonucleotide
aacatctaggagaggaagag

SEQ ID NO: 636 - DNA, 20 bp, Artificial Sequence
  Description of Artificial Sequence: Synthetic oligonucleotide
gttccacagaacccaacaac

SEQ ID NO: 637 - DNA, 20 bp, Artificial Sequence
  Description of Artificial Sequence: Synthetic oligonucleotide
ttcctacctgagccatctcc

SEQ ID NO: 638 - DNA, 20 bp, Artificial Sequence
  Description of Artificial Sequence: Synthetic oligonucleotide
atgctcacatgaagaagatg

SEQ ID NO: 639 - DNA, 20 bp, Artificial Sequence
  Description of Artificial Sequence: Synthetic oligonucleotide
gggaaacaagagaccagagc

SEQ ID NO: 640 - DNA, 20 bp, Artificial Sequence
  Description of Artificial Sequence: Synthetic oligonucleotide
tcactctgatgggagacacc

SEQ ID NO: 641 - DNA, 20 bp, Artificial Sequence
  Description of Artificial Sequence: Synthetic oligonucleotide
cactctgatgggagacacca

SEQ ID NO: 642 - DNA, 20 bp, Artificial Sequence
  Description of Artificial Sequence: Synthetic oligonucleotide
tttcttatggagaggaaaga

SEQ ID NO: 643 - DNA, 20 bp, Artificial Sequence
  Description of Artificial Sequence: Synthetic oligonucleotide
gtacaggtaagagcaacgcc

SEQ ID NO: 644 - DNA, 20 bp, Artificial Sequence
  Description of Artificial Sequence: Synthetic oligonucleotide
ctcttacctgtaccataacc

SEQ ID NO: 645 - DNA, 20 bp, Artificial Sequence
  Description of Artificial Sequence: Synthetic oligonucleotide
ttacctgtaccataaccagg

SEQ ID NO: 646 - DNA, 20 bp, Artificial Sequence
  Description of Artificial Sequence: Synthetic oligonucleotide
tgtatctgtaggaggagaag

SEQ ID NO: 647 - DNA, 20 bp, Artificial Sequence
  Description of Artificial Sequence: Synthetic oligonucleotide
gtatctgtaggaggagaagt

SEQ ID NO: 648 - DNA, 20 bp, Artificial Sequence
  Description of Artificial Sequence: Synthetic oligonucleotide
cagatacaaactggactctc

SEQ ID NO: 649 - DNA, 20 bp, Artificial Sequence
  Description of Artificial Sequence: Synthetic oligonucleotide
tcttaccttccttcgtttgc

SEQ ID NO: 650 - DNA, 20 bp, Artificial Sequence
  Description of Artificial Sequence: Synthetic oligonucleotide
tttggatctaaaacggtgac

SEQ ID NO: 651 - DNA, 20 bp, Artificial Sequence
  Description of Artificial Sequence: Synthetic oligonucleotide
gatctaaaacggtgacaggt

SEQ ID NO: 652 - DNA, 20 bp, Artificial Sequence
  Description of Artificial Sequence: Synthetic oligonucleotide
aaaggctcagcagttgacct

SEQ ID NO: 653 - DNA, 20 bp, Artificial Sequence
  Description of Artificial Sequence: Synthetic oligonucleotide
atttaccggcatagaatagt

SEQ ID NO: 654 - DNA, 20 bp, Artificial Sequence
  Description of Artificial Sequence: Synthetic oligonucleotide
tcactgcctaagagagacat

SEQ ID NO: 655 - DNA, 20 bp, Artificial Sequence
  Description of Artificial Sequence: Synthetic oligonucleotide
aggatccacgtggagaatgg

SEQ ID NO: 656 - DNA, 20 bp, Artificial Sequence
  Description of Artificial Sequence: Synthetic oligonucleotide
ggatccacgtggagaatggt

SEQ ID NO: 657 - DNA, 20 bp, Artificial Sequence
  Description of Artificial Sequence: Synthetic oligonucleotide
tctcactgttctcagggaag

SEQ ID NO: 658 - DNA, 20 bp, Artificial Sequence
  Description of Artificial Sequence: Synthetic oligonucleotide
cctgcccaaggcttcccacc

SEQ ID NO: 659 - DNA, 20 bp, Artificial Sequence
  Description of Artificial Sequence: Synthetic oligonucleotide
ctgcccaaggcttcccacct

SEQ ID NO: 660 - DNA, 20 bp, Artificial Sequence
  Description of Artificial Sequence: Synthetic oligonucleotide
gcctgctgcggtaagcggta

SEQ ID NO: 661 - DNA, 20 bp, Artificial Sequence
  Description of Artificial Sequence: Synthetic oligonucleotide
gatgctcagggaacacgtat

SEQ ID NO: 662 - DNA, 20 bp, Artificial Sequence
  Description of Artificial Sequence: Synthetic oligonucleotide
ttctcaaagttcccacatcc

SEQ ID NO: 663 - DNA, 20 bp, Artificial Sequence
  Description of Artificial Sequence: Synthetic oligonucleotide
tcacagattggtgagtagcc

SEQ ID NO: 664 - DNA, 20 bp, Artificial Sequence
  Description of Artificial Sequence: Synthetic oligonucleotide
ctcacctgttctgtgattac

SEQ ID NO: 665 - DNA, 20 bp, Artificial Sequence
  Description of Artificial Sequence: Synthetic oligonucleotide
tccttccagctactcaatcc

SEQ ID NO: 666 - DNA, 20 bp, Artificial Sequence
  Description of Artificial Sequence: Synthetic oligonucleotide
cacagtacaaataagagccc

SEQ ID NO: 667 - DNA, 20 bp, Artificial Sequence
  Description of Artificial Sequence: Synthetic oligonucleotide
ccccccagcgcttcggtgag

SEQ ID NO: 668 - DNA, 20 bp, Artificial Sequence
  Description of Artificial Sequence: Synthetic oligonucleotide
cccccagcgcttcggtgagt

SEQ ID NO: 669 - DNA, 20 bp, Artificial Sequence
  Description of Artificial Sequence: Synthetic oligonucleotide
ccactcaccgaagcgctggg

SEQ ID NO: 670 - DNA, 20 bp, Artificial Sequence
  Description of Artificial Sequence: Synthetic oligonucleotide
tacctcggaggaaagagaaa

SEQ ID NO: 671 - DNA, 20 bp, Artificial Sequence
  Description of Artificial Sequence: Synthetic oligonucleotide
cagcttccaaaacgacaagc

SEQ ID NO: 672 - DNA, 20 bp, Artificial Sequence
  Description of Artificial Sequence: Synthetic oligonucleotide
aacataccagcttgtcgttt

SEQ ID NO: 673 - DNA, 20 bp, Artificial Sequence
  Description of Artificial Sequence: Synthetic oligonucleotide
agaccacctgcagagacgag

SEQ ID NO: 674 - DNA, 20 bp, Artificial Sequence
  Description of Artificial Sequence: Synthetic oligonucleotide
ccacctgcagagacgagagg

SEQ ID NO: 675 - DNA, 20 bp, Artificial Sequence
  Description of Artificial Sequence: Synthetic oligonucleotide
ccacacccaaaaggccacac

SEQ ID NO: 676 - DNA, 20 bp, Artificial Sequence
  Description of Artificial Sequence: Synthetic oligonucleotide
cccaccagctcagctccacg

SEQ ID NO: 677 - DNA, 20 bp, Artificial Sequence
  Description of Artificial Sequence: Synthetic oligonucleotide
cgctgtcaagtccagttcta

SEQ ID NO: 678 - DNA, 20 bp, Artificial Sequence
  Description of Artificial Sequence: Synthetic oligonucleotide
gctgtcaagtccagttctac

SEQ ID NO: 679 - DNA, 20 bp, Artificial Sequence
  Description of Artificial Sequence: Synthetic oligonucleotide
cacccagatcgtcagcgccg

SEQ ID NO: 680 - DNA, 20 bp, Artificial Sequence
  Description of Artificial Sequence: Synthetic oligonucleotide
ccactcacctgctctacccc

SEQ ID NO: 681 - DNA, 20 bp, Artificial Sequence
  Description of Artificial Sequence: Synthetic oligonucleotide
ccacagtctgaaagaaagca

SEQ ID NO: 682 - DNA, 20 bp, Artificial Sequence
  Description of Artificial Sequence: Synthetic oligonucleotide
gacactgttggcacggagga

SEQ ID NO: 683 - DNA, 20 bp, Artificial Sequence
  Description of Artificial Sequence: Synthetic oligonucleotide
ttaccatggccatcaacaca

SEQ ID NO: 684 - DNA, 20 bp, Artificial Sequence
  Description of Artificial Sequence: Synthetic oligonucleotide
ccacacccaaaaggccacac

SEQ ID NO: 685 - DNA, 20 bp, Artificial Sequence
  Description of Artificial Sequence: Synthetic oligonucleotide
cccaccagctcagctccacg

SEQ ID NO: 686 - DNA, 20 bp, Artificial Sequence
  Description of Artificial Sequence: Synthetic oligonucleotide
cgctgtcaagtccagttcta

SEQ ID NO: 687 - DNA, 20 bp, Artificial Sequence
  Description of Artificial Sequence: Synthetic oligonucleotide
gctgtcaagtccagttctac

SEQ ID NO: 688 - DNA, 20 bp, Artificial Sequence
  Description of Artificial Sequence: Synthetic oligonucleotide
cacccagatcgtcagcgccg

SEQ ID NO: 689 - DNA, 20 bp, Artificial Sequence
  Description of Artificial Sequence: Synthetic oligonucleotide
ccacagtctgaaagaaaaca

SEQ ID NO: 690 - DNA, 20 bp, Artificial Sequence
  Description of Artificial Sequence: Synthetic oligonucleotide
cacagtctgaaagaaaacag

SEQ ID NO: 691 - DNA, 20 bp, Artificial Sequence
  Description of Artificial Sequence: Synthetic oligonucleotide
ttaccatggccatcagcacg

SEQ ID NO: 692 - DNA, 20 bp, Artificial Sequence
  Description of Artificial Sequence: Synthetic oligonucleotide
ccactcacctgctctacccc

SEQ ID NO: 693 - DNA, 20 bp, Artificial Sequence
  Description of Artificial Sequence: Synthetic oligonucleotide
tctgcgttcaggggtaagcg

SEQ ID NO: 694 - DNA, 20 bp, Artificial Sequence
  Description of Artificial Sequence: Synthetic oligonucleotide
gcgcttacccctgaacgcag

SEQ ID NO: 695 - DNA, 20 bp, Artificial Sequence
  Description of Artificial Sequence: Synthetic oligonucleotide
gactgggcagcggcccctgt

SEQ ID NO: 696 - DNA, 20 bp, Artificial Sequence
  Description of Artificial Sequence: Synthetic oligonucleotide
ggactgggcagcggcccctg

SEQ ID NO: 697 - DNA, 20 bp, Artificial Sequence
  Description of Artificial Sequence: Synthetic oligonucleotide
gtcatgcagcccttgcctgc

SEQ ID NO: 698 - DNA, 20 bp, Artificial Sequence
  Description of Artificial Sequence: Synthetic oligonucleotide
tcatgcagcccttgcctgct

SEQ ID NO: 699 - DNA, 20 bp, Artificial Sequence
  Description of Artificial Sequence: Synthetic oligonucleotide
catgcagcccttgcctgctg

SEQ ID NO: 700 - DNA, 20 bp, Artificial Sequence
  Description of Artificial Sequence: Synthetic oligonucleotide
ctcaccagattcccgaaggt

SEQ ID NO: 701 - DNA, 20 bp, Artificial Sequence
  Description of Artificial Sequence: Synthetic oligonucleotide
cagactcaccagattcccga

SEQ ID NO: 702 - DNA, 20 bp, Artificial Sequence
  Description of Artificial Sequence: Synthetic oligonucleotide
agcctaggcaagtgcagagg

SEQ ID NO: 703 - DNA, 20 bp, Artificial Sequence
  Description of Artificial Sequence: Synthetic oligonucleotide
cagcctaggcaagtgcagag

SEQ ID NO: 704 - DNA, 20 bp, Artificial Sequence
  Description of Artificial Sequence: Synthetic oligonucleotide
accagcctaggcaagtgcag

SEQ ID NO: 705 - DNA, 20 bp, Artificial Sequence
  Description of Artificial Sequence: Synthetic oligonucleotide
tggaaccccaataccagcct

SEQ ID NO: 706 - DNA, 20 bp, Artificial Sequence
  Description of Artificial Sequence: Synthetic oligonucleotide
cacctgcagaagatgccaga

SEQ ID NO: 707 - DNA, 20 bp, Artificial Sequence
  Description of Artificial Sequence: Synthetic oligonucleotide
cgctcacctgcaccagcctc

SEQ ID NO: 708 - DNA, 20 bp, Artificial Sequence
  Description of Artificial Sequence: Synthetic oligonucleotide
cttcctggcaagacacaaga

SEQ ID NO: 709 - DNA, 20 bp, Artificial Sequence
  Description of Artificial Sequence: Synthetic oligonucleotide
aattcagggagccattgaaa

SEQ ID NO: 710 - DNA, 20 bp, Artificial Sequence
  Description of Artificial Sequence: Synthetic oligonucleotide
ctactgacctgccttttcaa

SEQ ID NO: 711 - DNA, 20 bp, Artificial Sequence
  Description of Artificial Sequence: Synthetic oligonucleotide
gcctctcaaagtcttatgtg

SEQ ID NO: 712 - DNA, 20 bp, Artificial Sequence
  Description of Artificial Sequence: Synthetic oligonucleotide
ttcccatgctgctttacttc

SEQ ID NO: 713 - DNA, 20 bp, Artificial Sequence
  Description of Artificial Sequence: Synthetic oligonucleotide
tttaggtcaaccagatgtag

SEQ ID NO: 714 - DNA, 20 bp, Artificial Sequence
  Description of Artificial Sequence: Synthetic oligonucleotide
tgtgcctgaaagcaaaaatg

SEQ ID NO: 715 - DNA, 20 bp, Artificial Sequence
  Description of Artificial Sequence: Synthetic oligonucleotide
ttacctactattcttgccag

SEQ ID NO: 716 - DNA, 20 bp, Artificial Sequence
  Description of Artificial Sequence: Synthetic oligonucleotide
aaatgctgtttaaaaaaagg

SEQ ID NO: 717 - DNA, 20 bp, Artificial Sequence
  Description of Artificial Sequence: Synthetic oligonucleotide
ccccaaaaagtgaatatcaa

SEQ ID NO: 718 - DNA, 20 bp, Artificial Sequence
  Description of Artificial Sequence: Synthetic oligonucleotide
gtccagaatttccagaagta

SEQ ID NO: 719 - DNA, 20 bp, Artificial Sequence
  Description of Artificial Sequence: Synthetic oligonucleotide
tccctggaggggtgggggag

SEQ ID NO: 720 - DNA, 20 bp, Artificial Sequence
  Description of Artificial Sequence: Synthetic oligonucleotide
tcacttcaacaggactccta

SEQ ID NO: 721 - DNA, 20 bp, Artificial Sequence
  Description of Artificial Sequence: Synthetic oligonucleotide
ccttacactcaaaggcaaag

SEQ ID NO: 722 - DNA, 20 bp, Artificial Sequence
  Description of Artificial Sequence: Synthetic oligonucleotide
atggctgcagggagaggaag

SEQ ID NO: 723 - DNA, 20 bp, Artificial Sequence
  Description of Artificial Sequence: Synthetic oligonucleotide
ggagcgccaggggatgctgg

SEQ ID NO: 724 - DNA, 20 bp, Artificial Sequence
  Description of Artificial Sequence: Synthetic oligonucleotide
tcacgtcccatgcagccaca

SEQ ID NO: 725 - DNA, 20 bp, Artificial Sequence
  Description of Artificial Sequence: Synthetic oligonucleotide
tggacgtctggtggggagta

SEQ ID NO: 726 - DNA, 20 bp, Artificial Sequence
  Description of Artificial Sequence: Synthetic oligonucleotide
actcacattgatgaggaaga

SEQ ID NO: 727 - DNA, 20 bp, Artificial Sequence
  Description of Artificial Sequence: Synthetic oligonucleotide
cagcatctgagaaaggcaga

SEQ ID NO: 728 - DNA, 20 bp, Artificial Sequence
  Description of Artificial Sequence: Synthetic oligonucleotide
aatccaacacctcagcgatg

SEQ ID NO: 729 - DNA, 20 bp, Artificial Sequence
  Description of Artificial Sequence: Synthetic oligonucleotide
atccaacacctcagcgatgt

SEQ ID NO: 730 - DNA, 20 bp, Artificial Sequence
  Description of Artificial Sequence: Synthetic oligonucleotide
cgcggcgcagtacccgctgc

SEQ ID NO: 731 - DNA, 20 bp, Artificial Sequence
  Description of Artificial Sequence: Synthetic oligonucleotide
cactcaccgtggtgggtcgg

SEQ ID NO: 732 - DNA, 20 bp, Artificial Sequence
  Description of Artificial Sequence: Synthetic oligonucleotide
actcaccgtggtgggtcgga

SEQ ID NO: 733 - DNA, 20 bp, Artificial Sequence
  Description of Artificial Sequence: Synthetic oligonucleotide
tggctccctgtggggcaacg

SEQ ID NO: 734 - DNA, 20 bp, Artificial Sequence
  Description of Artificial Sequence: Synthetic oligonucleotide
gattccagggggaggcggtg

SEQ ID NO: 735 - DNA, 20 bp, Artificial Sequence
  Description of Artificial Sequence: Synthetic oligonucleotide
gctcctacctgtgctggacc

SEQ ID NO: 736 - DNA, 20 bp, Artificial Sequence
  Description of Artificial Sequence: Synthetic oligonucleotide
tcgccgccacagtggggtcg

SEQ ID NO: 737 - DNA, 20 bp, Artificial Sequence
  Description of Artificial Sequence: Synthetic oligonucleotide
cagactgagagtggggagag

SEQ ID NO: 738 - DNA, 20 bp, Artificial Sequence
  Description of Artificial Sequence: Synthetic oligonucleotide
cctcctccagagtgtggttg

SEQ ID NO: 739 - DNA, 20 bp, Artificial Sequence
  Description of Artificial Sequence: Synthetic oligonucleotide
agccatcccagggagagagc

SEQ ID NO: 740 - DNA, 20 bp, Artificial Sequence
  Description of Artificial Sequence: Synthetic oligonucleotide
gccatcccagggagagagct

SEQ ID NO: 741 - DNA, 20 bp, Artificial Sequence
  Description of Artificial Sequence: Synthetic oligonucleotide
ccatcccagggagagagctg

SEQ ID NO: 742 - DNA, 20 bp, Artificial Sequence
  Description of Artificial Sequence: Synthetic oligonucleotide
ctcacaggccacccaccagc

SEQ ID NO: 743 - DNA, 20 bp, Artificial Sequence
  Description of Artificial Sequence: Synthetic oligonucleotide
ccgcttccagaagtgcctgg

SEQ ID NO: 744 - DNA, 20 bp, Artificial Sequence
  Description of Artificial Sequence: Synthetic oligonucleotide
cttccagaagtgcctggcgg

SEQ ID NO: 745 - DNA, 20 bp, Artificial Sequence
  Description of Artificial Sequence: Synthetic oligonucleotide
acaactgcaaaggaatgggt

SEQ ID NO: 746 - DNA, 20 bp, Artificial Sequence
  Description of Artificial Sequence: Synthetic oligonucleotide
caactgcaaaggaatgggta

SEQ ID NO: 747 - DNA, 20 bp, Artificial Sequence
  Description of Artificial Sequence: Synthetic oligonucleotide
gaactaggaagacggtccag

SEQ ID NO: 748 - DNA, 20 bp, Artificial Sequence
  Description of Artificial Sequence: Synthetic oligonucleotide
ggctgaccaggacctgttgc

SEQ ID NO: 749 - DNA, 20 bp, Artificial Sequence
  Description of Artificial Sequence: Synthetic oligonucleotide
ctcacctgtacgccaggcgg

SEQ ID NO: 750 - DNA, 20 bp, Artificial Sequence
  Description of Artificial Sequence: Synthetic oligonucleotide
gctctcacctgtacgccagg

SEQ ID NO: 751 - DNA, 20 bp, Artificial Sequence
  Description of Artificial Sequence: Synthetic oligonucleotide
cttagacctggcaggcagat

SEQ ID NO: 752 - DNA, 20 bp, Artificial Sequence
  Description of Artificial Sequence: Synthetic oligonucleotide
caatccagtccccgaagcca

SEQ ID NO: 753 - DNA, 20 bp, Artificial Sequence
  Description of Artificial Sequence: Synthetic oligonucleotide
aatccagtccccgaagccac

SEQ ID NO: 754 - DNA, 20 bp, Artificial Sequence
  Description of Artificial Sequence: Synthetic oligonucleotide
actcaccggtgatgaggaca

SEQ ID NO: 755 - DNA, 20 bp, Artificial Sequence
  Description of Artificial Sequence: Synthetic oligonucleotide
ctcaccggtgatgaggacaa

SEQ ID NO: 756 - DNA, 20 bp, Artificial Sequence
  Description of Artificial Sequence: Synthetic oligonucleotide
ccggtctgcgggaagggtac

SEQ ID NO: 757 - DNA, 20 bp, Artificial Sequence
  Description of Artificial Sequence: Synthetic oligonucleotide
tgggctgcaggagccgcggc

SEQ ID NO: 758 - DNA, 20 bp, Artificial Sequence
  Description of Artificial Sequence: Synthetic oligonucleotide
ttgtaccaaatgcccctgtc

SEQ ID NO: 759 - DNA, 20 bp, Artificial Sequence
  Description of Artificial Sequence: Synthetic oligonucleotide
cggacagcagtcctccatta

SEQ ID NO: 760 - DNA, 20 bp, Artificial Sequence
  Description of Artificial Sequence: Synthetic oligonucleotide
aggtgcagcacagccccatg

SEQ ID NO: 761 - DNA, 20 bp, Artificial Sequence
  Description of Artificial Sequence: Synthetic oligonucleotide
ggtgcagcacagccccatgt

SEQ ID NO: 762 - DNA, 20 bp, Artificial Sequence
  Description of Artificial Sequence: Synthetic oligonucleotide
agttgccagatgcgcttcga

SEQ ID NO: 763 - DNA, 20 bp, Artificial Sequence
  Description of Artificial Sequence: Synthetic oligonucleotide
gttgccagatgcgcttcgac

SEQ ID NO: 764 - DNA, 20 bp, Artificial Sequence
  Description of Artificial Sequence: Synthetic oligonucleotide
gtctcagctgctcgacacgc

SEQ ID NO: 765 - DNA, 20 bp, Artificial Sequence
  Description of Artificial Sequence: Synthetic oligonucleotide
ttcttaccctggaatagtcc

SEQ ID NO: 766 - DNA, 20 bp, Artificial Sequence
  Description of Artificial Sequence: Synthetic oligonucleotide
attacctgtatgctaatcga

SEQ ID NO: 767 - DNA, 20 bp, Artificial Sequence
  Description of Artificial Sequence: Synthetic oligonucleotide
ttgcaatgcgttcgtggctt

SEQ ID NO: 768 - DNA, 20 bp, Artificial Sequence
  Description of Artificial Sequence: Synthetic oligonucleotide
actgacctgtgaccatagcc

SEQ ID NO: 769 - DNA, 20 bp, Artificial Sequence
  Description of Artificial Sequence: Synthetic oligonucleotide
tatctgcagggacagagaaa

SEQ ID NO: 770 - DNA, 20 bp, Artificial Sequence
  Description of Artificial Sequence: Synthetic oligonucleotide
tgcggcgcagacatacagct

SEQ ID NO: 771 - DNA, 20 bp, Artificial Sequence
  Description of Artificial Sequence: Synthetic oligonucleotide
ccccgcaggcgggggcgtta

SEQ ID NO: 772 - DNA, 20 bp, Artificial Sequence
  Description of Artificial Sequence: Synthetic oligonucleotide
tttcagaagtgtctcagtgt

SEQ ID NO: 773 - DNA, 20 bp, Artificial Sequence
  Description of Artificial Sequence: Synthetic oligonucleotide
attacctgatggaaagtctg

SEQ ID NO: 774 - DNA, 20 bp, Artificial Sequence
  Description of Artificial Sequence: Synthetic oligonucleotide
cttcagtgccttcgtggatt

SEQ ID NO: 775 - DNA, 20 bp, Artificial Sequence
  Description of Artificial Sequence: Synthetic oligonucleotide
tttctgcagagggatagaga

SEQ ID NO: 776 - DNA, 20 bp, Artificial Sequence
  Description of Artificial Sequence: Synthetic oligonucleotide
agaccaccagagtaagggac

SEQ ID NO: 777 - DNA, 20 bp, Artificial Sequence
  Description of Artificial Sequence: Synthetic oligonucleotide
acttgcagccctcggccaaa

SEQ ID NO: 778 - DNA, 20 bp, Artificial Sequence
  Description of Artificial Sequence: Synthetic oligonucleotide
agggctcaccagaggtagga

SEQ ID NO: 779 - DNA, 20 bp, Artificial Sequence
  Description of Artificial Sequence: Synthetic oligonucleotide
ttcacctgcccaaggaaaaa

SEQ ID NO: 780 - DNA, 20 bp, Artificial Sequence
  Description of Artificial Sequence: Synthetic oligonucleotide
ctaagcctagaaaatcagtt

SEQ ID NO: 781 - DNA, 20 bp, Artificial Sequence
  Description of Artificial Sequence: Synthetic oligonucleotide
acatctagaaaaaaaaatac

SEQ ID NO: 782 - DNA, 20 bp, Artificial Sequence
  Description of Artificial Sequence: Synthetic oligonucleotide
attaccttcctctttgcact

SEQ ID NO: 783 - DNA, 20 bp, Artificial Sequence
  Description of Artificial Sequence: Synthetic oligonucleotide
gatcctgtaggttggaacat

SEQ ID NO: 784 - DNA, 20 bp, Artificial Sequence
  Description of Artificial Sequence: Synthetic oligonucleotide
aagccaccccaagttagatc

SEQ ID NO: 785 - DNA, 20 bp, Artificial Sequence
  Description of Artificial Sequence: Synthetic oligonucleotide
aacttaccccaaacaattag

SEQ ID NO: 786 - DNA, 20 bp, Artificial Sequence
  Description of Artificial Sequence: Synthetic oligonucleotide
atacctacaggatttaaagt

SEQ ID NO: 787 - DNA, 20 bp, Artificial Sequence
  Description of Artificial Sequence: Synthetic oligonucleotide
gtttcctagaaagcaaaaaa

SEQ ID NO: 788 - DNA, 20 bp, Artificial Sequence
  Description of Artificial Sequence: Synthetic oligonucleotide
aagttcaactgcttcgtaat

SEQ ID NO: 789 - DNA, 20 bp, Artificial Sequence
  Description of Artificial Sequence: Synthetic oligonucleotide
aattcagactatcatcctca

SEQ ID NO: 790 - DNA, 20 bp, Artificial Sequence
  Description of Artificial Sequence: Synthetic oligonucleotide
gcttgcagctgtgggacacc

SEQ ID NO: 791 - DNA, 20 bp, Artificial Sequence
  Description of Artificial Sequence: Synthetic oligonucleotide
gaccactcaaccagtgccca

SEQ ID NO: 792 - DNA, 20 bp, Artificial Sequence
  Description of Artificial Sequence: Synthetic oligonucleotide
ggaggcacagaccactccac

SEQ ID NO: 793 - DNA, 20 bp, Artificial Sequence
  Description of Artificial Sequence: Synthetic oligonucleotide
ggcacagacaactcgactga

SEQ ID NO: 794 - DNA, 20 bp, Artificial Sequence
  Description of Artificial Sequence: Synthetic oligonucleotide
ggaggcacagaccactccac

SEQ ID NO: 795 - DNA, 20 bp, Artificial Sequence
  Description of Artificial Sequence: Synthetic oligonucleotide
gcacagaccactcaacccac

SEQ ID NO: 796 - DNA, 20 bp, Artificial Sequence
  Description of Artificial Sequence: Synthetic oligonucleotide
gaccactcaacccacaggcc

SEQ ID NO: 797 - DNA, 20 bp, Artificial Sequence
  Description of Artificial Sequence: Synthetic oligonucleotide
gaccactcaaaccacagcca

SEQ ID NO: 798 - DNA, 20 bp, Artificial Sequence
  Description of Artificial Sequence: Synthetic oligonucleotide
gaccactcaacccacagcca

SEQ ID NO: 799 - DNA, 20 bp, Artificial Sequence
  Description of Artificial Sequence: Synthetic oligonucleotide
ggaggcacagaccactccac

SEQ ID NO: 800 - DNA, 20 bp, Artificial Sequence
  Description of Artificial Sequence: Synthetic oligonucleotide
gaccactcaaccagcagcca

SEQ ID NO: 801 - DNA, 20 bp, Artificial Sequence
  Description of Artificial Sequence: Synthetic oligonucleotide
cctgcagagaaacacacttg

SEQ ID NO: 802 - DNA, 117 bp, Artificial Sequence
  Description of Artificial Sequence: Synthetic oligonucleotide
  Description of Combined DNA/RNA Molecule: Synthetic oligonucleotide
  modified_base (98)..(117): a, c, t, g, unknown or other
guucugtcuuuuggucaggacaaccgucuagcuauaagugcugcagggugugagaaacuccuauugcuggacgaugucucuuacgaggcauuagcacnnnnnnnnnnnnnnnnnnnn

SEQ ID NO: 803 - RNA, 108 nt, Artificial Sequence
  Description of Artificial Sequence: Synthetic polynucleotide
  modified_base (89)..(108): a, c, u, g, unknown or other
gaccuauagggucaaugaaucugugcgugugccauaaguaauuaaaaauuacccaccacaggagcaccugaaaacaggugcuuggcacnnnnnnnnnnnnnnnnnnnn

SEQ ID NO: 804 - RNA, 119 nt, Artificial Sequence
  Description of Artificial Sequence: Synthetic polynucleotide
  modified_base (100)..(119): a, c, u, g, unknown or other
gucuaaaggacagaauuuuucaacgggugugccaauggccacuuuccagguggcaaagcccguugaacuucucaaaaagaacgaucugagaaguggcacnnnnnnnnnnnnnnnnnnnn

SEQ ID NO: 805 - protein, 20 aa, Artificial Sequence
  Description of Artificial Sequence: Synthetic peptide
GSSGSETPGTSESATPESSG

SEQ ID NO: 806 - DNA, 18 bp, Artificial Sequence
  Description of Artificial Sequence: Synthetic oligonucleotide
ggaggctctggaggaagc

SEQ ID NO: 807 - DNA, 60 bp, Artificial Sequence
  Description of Artificial Sequence: Synthetic oligonucleotide
ggctcttctggatctgaaacacctggcacaagcgagagcgccacccctgagagctctggc

SEQ ID NO: 808 - protein, 17 aa, Artificial Sequence
  Description of Artificial Sequence: Synthetic peptide
MAPKKKRKVGIHGVPAA

SEQ ID NO: 809 - DNA, 51 bp, Artificial Sequence
  Description of Artificial Sequence: Synthetic oligonucleotide
atggccccaaagaagaagcggaaggtcggtatccacggagtcccagcagcc

SEQ ID NO: 810 - protein, 1368 aa, Artificial Sequence [sequence omitted]

SEQ ID NO: 811 - RNA, 20 nt, Artificial Sequence
  Description of Artificial Sequence: Synthetic oligonucleotide
gaacacaaagcauagacugc

SEQ ID NO: 812 - RNA, 20 nt, Artificial Sequence
  Description of Artificial Sequence: Synthetic oligonucleotide
gggaaagacccagcauccgu

SEQ ID NO: 813 - RNA, 20 nt, Artificial Sequence
  Description of Artificial Sequence: Synthetic oligonucleotide
gcucccaucacaucaaccgg

SEQ ID NO: 814 - RNA, 20 nt, Artificial Sequence
  Description of Artificial Sequence: Synthetic oligonucleotide
ggugagugagugugugcgug

SEQ ID NO: 815 - RNA, 20 nt, Artificial Sequence
  Description of Artificial Sequence: Synthetic oligonucleotide
ggcuucagguucuaaaugag

SEQ ID NO: 816 - RNA, 20 nt, Artificial Sequence
  Description of Artificial Sequence: Synthetic oligonucleotide
gcagagagucgccgucucca

SEQ ID NO: 817 - RNA, 20 nt, Artificial Sequence
  Description of Artificial Sequence: Synthetic oligonucleotide
guguaagaccucaaaagcac

SEQ ID NO: 818 - RNA, 20 nt, Artificial Sequence
  Description of Artificial Sequence: Synthetic oligonucleotide
gaugagaaggagaaguucuu

SEQ ID NO: 819 - RNA, 20 nt, Artificial Sequence
  Description of Artificial Sequence: Synthetic oligonucleotide
gaggacaaaguacaaacggc

SEQ ID NO: 820 - RNA, 20 nt, Artificial Sequence
  Description of Artificial Sequence: Synthetic oligonucleotide
gccaccacagggaagcuggg

SEQ ID NO: 821 - RNA, 20 nt, Artificial Sequence
  Description of Artificial Sequence: Synthetic oligonucleotide
gcucucaggcccuguccgca

SEQ ID NO: 822 - RNA, 20 nt, Artificial Sequence
  Description of Artificial Sequence: Synthetic oligonucleotide
gagcaaauaccagagauaag

SEQ ID NO: 823 - RNA, 20 nt, Artificial Sequence
  Description of Artificial Sequence: Synthetic oligonucleotide
gaucaggaaauagagccaca

SEQ ID NO: 824 - RNA, 20 nt, Artificial Sequence
  Description of Artificial Sequence: Synthetic oligonucleotide
gcccaucccugaguccagcg

SEQ ID NO: 825 - RNA, 23 nt, Artificial Sequence
  Description of Artificial Sequence: Synthetic oligonucleotide
gaacacgaagacaucugaaggua

SEQ ID NO: 826 - RNA, 23 nt, Artificial Sequence
  Description of Artificial Sequence: Synthetic oligonucleotide
gauuuacagccuggccuuugggg

SEQ ID NO: 827 - RNA, 22 nt, Artificial Sequence
  Description of Artificial Sequence: Synthetic oligonucleotide
ggagagaaagagaaguugauug

SEQ ID NO: 828 - RNA, 22 nt, Artificial Sequence
  Description of Artificial Sequence: Synthetic oligonucleotide
gagggugagggaugagauaaug

SEQ ID NO: 829 - RNA, 22 nt, Artificial Sequence
  Description of Artificial Sequence: Synthetic oligonucleotide
gguggaggagggugcauggggu

SEQ ID NO: 830 - RNA, 22 nt, Artificial Sequence
  Description of Artificial Sequence: Synthetic oligonucleotide
gcuguugcaugaggaaagggac

SEQ ID NO: 831 - RNA, 20 nt, Artificial Sequence
  Description of Artificial Sequence: Synthetic oligonucleotide
ggcccagacugagcacguga

SEQ ID NO: 832 - RNA, 20 nt, Artificial Sequence
  Description of Artificial Sequence: Synthetic oligonucleotide
ggcacugcggcuggaggugg

SEQ ID NO: 833 - RNA, 21 nt, Artificial Sequence
  Description of Artificial Sequence: Synthetic oligonucleotide
gcagagcacuggaauucguca

SEQ ID NO: 834 - RNA, 76 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugc

SEQ ID NO: 835 - RNA, 84 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgaga

SEQ ID NO: 836 - DNA, 933 bp, Unknown
  Description of Unknown: kanamycin resistance gene sequence
ccggaattgccagctggggcgccctctggtaaggttgggaagccctgcaaagtaaactggatggctttcttgccgccaaggatctgatggcgcaggggatcaagatctgatcaagagacaggatgaggatcctttcgcatgatcgaataagatggattgcacgcaggttctccggccgcttaggtggagcgcctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcattaactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaa

SEQ ID NO: 837 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnccagccccatctgtcaaact

SEQ ID NO: 838 - DNA, 54 bp, Artificial Sequence
  Description of Artificial Sequence: Synthetic oligonucleotide
tggagttcagacgtgtgctcttccgatcttgaatggattccttggaaacaatga

SEQ ID NO: 839 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntgagggagagccgtgtagtt

SEQ ID NO: 840 - DNA, 49 bp, Artificial Sequence
  Description of Artificial Sequence: Synthetic oligonucleotide
tggagttcagacgtgtgctcttccgatctgcctctcaaagtgctgggat

SEQ ID NO: 841 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnccatcaggctctcagctcag

SEQ ID NO: 842 - DNA, 48 bp, Artificial Sequence
  Description of Artificial Sequence: Synthetic oligonucleotide
tggagttcagacgtgtgctcttccgatctctcgtgggtttgtggttgc

SEQ ID NO: 843 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnngcccattccctctttagcca

SEQ ID NO: 844 - DNA, 49 bp, Artificial Sequence
  Description of Artificial Sequence: Synthetic oligonucleotide
tggagttcagacgtgtgctcttccgatctgagccgttccctctttgcta

SEQ ID NO: 845 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnaacctgtgtgacacttggca

SEQ ID NO: 846 - DNA, 49 bp, Artificial Sequence
  Description of Artificial Sequence: Synthetic oligonucleotide
tggagttcagacgtgtgctcttccgatctgtctggcccaagatcacaca

SEQ ID NO: 847 - DNA, 56 bp, Artificial Sequence
  Description of Artificial Sequence: Synthetic oligonucleotide
  modified_base (34)..(36): a, c, t, g, unknown or other
acactctttccctacacgacgctcttccgatctnnncacggataaagacgctggga

SEQ ID NO: 848 - DNA, 47 bp, Artificial Sequence
  Description of Artificial Sequence: Synthetic oligonucleotide
tggagttcagacgtgtgctcttccgatctggggtcccaggtgctgac

SEQ ID NO: 849 - DNA, 56 bp, Artificial Sequence
  Description of Artificial Sequence: Synthetic oligonucleotide
  modified_base (34)..(36): a, c, t, g, unknown or other
acactctttccctacacgacgctcttccgatctnnnttgattgtctcctttgccgc

SEQ ID NO: 850 - DNA, 53 bp, Artificial Sequence
  Description of Artificial Sequence: Synthetic oligonucleotide
tggagttcagacgtgtgctcttccgatcttgacccagtgtttgatagatcagt

SEQ ID NO: 851 - DNA, 56 bp, Artificial Sequence
  Description of Artificial Sequence: Synthetic oligonucleotide
  modified_base (34)..(36): a, c, t, g, unknown or other
acactctttccctacacgacgctcttccgatctnnncaccccttcagtccatgctt

SEQ ID NO: 852 - DNA, 49 bp, Artificial Sequence
  Description of Artificial Sequence: Synthetic oligonucleotide
tggagttcagacgtgtgctcttccgatcttctgatggggaggaacgagt

SEQ ID NO: 853 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnncagctcagcctgagtgttga

SEQ ID NO: 854 - DNA, 49 bp, Artificial Sequence
  Description of Artificial Sequence: Synthetic oligonucleotide
tggagttcagacgtgtgctcttccgatctgcccaccctagtcattggag

SEQ ID NO: 855 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnngtcagagggacacactgtgg

SEQ ID NO: 856 - DNA, 49 bp, Artificial Sequence
  Description of Artificial Sequence: Synthetic oligonucleotide
tggagttcagacgtgtgctcttccgatctcacactcactcacccacaca

SEQ ID NO: 857 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntgtgtgggtgagtgagtgtg

SEQ ID NO: 858 - DNA, 49 bp, Artificial Sequence
  Description of Artificial Sequence: Synthetic oligonucleotide
tggagttcagacgtgtgctcttccgatctcaccaaggttcacagcctga

SEQ ID NO: 859 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnttgtctctgcctgtagctgc

SEQ ID NO: 860 - DNA, 49 bp, Artificial Sequence
  Description of Artificial Sequence: Synthetic oligonucleotide
tggagttcagacgtgtgctcttccgatctcgctctgggcttcatcttca

SEQ ID NO: 861 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntgggattatgggtgtgagcc

SEQ ID NO: 862 - DNA, 49 bp, Artificial Sequence
  Description of Artificial Sequence: Synthetic oligonucleotide
tggagttcagacgtgtgctcttccgatcttgccttcctcctctctctcc

SEQ ID NO: 863 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntgcagaccagattcggagaa

SEQ ID NO: 864 - DNA, 49 bp, Artificial Sequence
  Description of Artificial Sequence: Synthetic oligonucleotide
tggagttcagacgtgtgctcttccgatctgttcagtttccagggggtcc

SEQ ID NO: 865 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntccgcacagccttagttcaa

SEQ ID NO: 866 - DNA, 49 bp, Artificial Sequence
  Description of Artificial Sequence: Synthetic oligonucleotide
tggagttcagacgtgtgctcttccgatctaacttgaagagacggcagca

SEQ ID NO: 867 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnncccccagctacagaaaggtc

SEQ ID NO: 868 - DNA, 49 bp, Artificial Sequence
  Description of Artificial Sequence: Synthetic oligonucleotide
tggagttcagacgtgtgctcttccgatctatttccaccgcaaaatggcc

SEQ ID NO: 869 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntcacttcagcccaggagtat

SEQ ID NO: 870 - DNA, 51 bp, Artificial Sequence
  Description of Artificial Sequence: Synthetic oligonucleotide
tggagttcagacgtgtgctcttccgatcttgtgtatggtgagaggtaggga

SEQ ID NO: 871 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnngtctgaggtcacacagtggg

SEQ ID NO: 872 - DNA, 49 bp, Artificial Sequence
  Description of Artificial Sequence: Synthetic oligonucleotide
tggagttcagacgtgtgctcttccgatctctgagagcagggaccacatc

SEQ ID NO: 873 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnngggaggtggagagaggatgt

SEQ ID NO: 874 - DNA, 54 bp, Artificial Sequence
  Description of Artificial Sequence: Synthetic oligonucleotide
tggagttcagacgtgtgctcttccgatctactcttcctgaggtctaggaacccg

SEQ ID NO: 875 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnccctgttcctaaagcccacc

SEQ ID NO: 876 - DNA, 53 bp, Artificial Sequence
  Description of Artificial Sequence: Synthetic oligonucleotide
tggagttcagacgtgtgctcttccgatctactctctggttctgtttgtggcca

SEQ ID NO: 877 - DNA, 60 bp, Artificial Sequence
  Description of Artificial Sequence: Synthetic oligonucleotide
  modified_base (34)..(37): a, c, t, g, unknown or other
acactctttccctacacgacgctcttccgatctnnnnatttgatggagttggacatggcc

SEQ ID NO: 878 - DNA, 46 bp, Artificial Sequence
  Description of Artificial Sequence: Synthetic oligonucleotide
tggagttcagacgtgtgctctccagctacttgttcttgagtgaagg

SEQ ID NO: 879 - DNA, 59 bp, Artificial Sequence
  Description of Artificial Sequence: Synthetic oligonucleotide
  modified_base (34)..(37): a, c, t, g, unknown or other
acactctttccctacacgacgctcttccgatctnnnntggctttccaaatcagtgggtc

SEQ ID NO: 880 - DNA, 52 bp, Artificial Sequence
  Description of Artificial Sequence: Synthetic oligonucleotide
tggagttcagacgtgtgctcttccgatctctcataagcttagaccaacaagc

SEQ ID NO: 881 - DNA, 58 bp, Artificial Sequence
  Description of Artificial Sequence: Synthetic oligonucleotide
  modified_base (34)..(37): a, c, t, g, unknown or other
acactctttccctacacgacgctcttccgatctnnnnctggttgaccaatctgtggtg

SEQ ID NO: 882 - DNA, 41 bp, Artificial Sequence
  Description of Artificial Sequence: Synthetic oligonucleotide
tggagttcagacgtgtgctctctgcgtctggatcaggtacg

SEQ ID NO: 883 - DNA, 58 bp, Artificial Sequence
  Description of Artificial Sequence: Synthetic oligonucleotide
  modified_base (34)..(37): a, c, t, g, unknown or other
acactctttccctacacgacgctcttccgatctnnnngtgtggagagtgagtaagcca

SEQ ID NO: 884 - DNA, 50 bp, Artificial Sequence
  Description of Artificial Sequence: Synthetic oligonucleotide
tggagttcagacgtgtgctcttccgatctacggtaggatgatttcaggca

SEQ ID NO: 885 - DNA, 58 bp, Artificial Sequence
  Description of Artificial Sequence: Synthetic oligonucleotide
  modified_base (34)..(37): a, c, t, g, unknown or other
acactctttccctacacgacgctcttccgatctnnnncacaaagcagtgtagctcagg

SEQ ID NO: 886 - DNA, 54 bp, Artificial Sequence
  Description of Artificial Sequence: Synthetic oligonucleotide
tggagttcagacgtgtgctcttccgatcttttttggtactcgagtgttattcag

SEQ ID NO: 887 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntcccctgttgacctggagaa

SEQ ID NO: 888 - DNA, 49 bp, Artificial Sequence
  Description of Artificial Sequence: Synthetic oligonucleotide
tggagttcagacgtgtgctcttccgatctcactgtacttgccctgacca

SEQ ID NO: 889 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnttggtgttgacagggagcaa

SEQ ID NO: 890 - DNA, 49 bp, Artificial Sequence
  Description of Artificial Sequence: Synthetic oligonucleotide
tggagttcagacgtgtgctcttccgatctctgagatgtgggcagaaggg

SEQ ID NO: 891 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntgagagggaacagaagggct

SEQ ID NO: 892 - DNA, 49 bp, Artificial Sequence
  Description of Artificial Sequence: Synthetic oligonucleotide
tggagttcagacgtgtgctcttccgatctgtccaaaggcccaagaacct

SEQ ID NO: 893 - DNA, 58 bp, Artificial Sequence
  Description of Artificial Sequence: Synthetic oligonucleotide
  modified_base (34)..(37): a, c, t, g, unknown or other
acactctttccctacacgacgctcttccgatctnnnntcctagcactttggaaggtcg

SEQ ID NO: 894 - DNA, 51 bp, Artificial Sequence
  Description of Artificial Sequence: Synthetic oligonucleotide
tggagttcagacgtgtgctcttccgatctgctcatcttaatctgctcagcc

SEQ ID NO: 895 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnaaaggagcagctcttcctgg

SEQ ID NO: 896 - DNA, 49 bp, Artificial Sequence
  Description of Artificial Sequence: Synthetic oligonucleotide
tggagttcagacgtgtgctcttccgatctgtctgcaccatctcccacaa

SEQ ID NO: 897 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnggcatggcttctgagactca

SEQ ID NO: 898 - DNA, 53 bp, Artificial Sequence
  Description of Artificial Sequence: Synthetic oligonucleotide
tggagttcagacgtgtgctcttccgatctgtctcccttgcactccctgtcttt

SEQ ID NO: 899 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntttggcaatggaggcattgg

SEQ ID NO: 900 - DNA, 49 bp, Artificial Sequence
  Description of Artificial Sequence: Synthetic oligonucleotide
tggagttcagacgtgtgctcttccgatctgaagaggctgcccatgagag

SEQ ID NO: 901 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnnggtctgaggctcgaatcctg

SEQ ID NO: 902 - DNA, 49 bp, Artificial Sequence
  Description of Artificial Sequence: Synthetic oligonucleotide
tggagttcagacgtgtgctcttccgatctctgtggcctccatatccctg

SEQ ID NO: 903 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnntttccaccagaactcagccc

SEQ ID NO: 904 - DNA, 49 bp, Artificial Sequence
  Description of Artificial Sequence: Synthetic oligonucleotide
tggagttcagacgtgtgctcttccgatctcctcggttcctccacaacac

SEQ ID NO: 905 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnncacgggaaggacaggagaag

SEQ ID NO: 906 - DNA, 49 bp, Artificial Sequence
  Description of Artificial Sequence: Synthetic oligonucleotide
tggagttcagacgtgtgctcttccgatctgcaggggagggataaagcag

SEQ ID NO: 907 - DNA, 59 bp, Artificial Sequence
  Description of Artificial Sequence: Synthetic oligonucleotide
  modified_base (34)..(37): a, c, t, g, unknown or other
acactctttccctacacgacgctcttccgatctnnnnggaaacgcccatgcaattagtc

SEQ ID NO: 908 - DNA, 51 bp, Artificial Sequence
  Description of Artificial Sequence: Synthetic oligonucleotide
tggagttcagacgtgtgctcttccgatctcttgtcaaccagtatcccggtg

SEQ ID NO: 909 - DNA, 61 bp, Artificial Sequence
  Description of Artificial Sequence: Synthetic oligonucleotide
  modified_base (34)..(37): a, c, t, g, unknown or other
acactctttccctacacgacgctcttccgatctnnnntgaatggattccttggaaacaatg

SEQ ID NO: 910 - DNA, 49 bp, Artificial Sequence
  Description of Artificial Sequence: Synthetic oligonucleotide
tggagttcagacgtgtgctcttccgatctccagccccatctgtcaaact

SEQ ID NO: 911 - DNA, 49 bp, Artificial Sequence
  Description of Artificial Sequence: Synthetic oligonucleotide
tggagttcagacgtgtgctcttccgatcttcctttcaacccgaacggag

SEQ ID NO: 912 - DNA, 57 bp, Artificial Sequence
  Description of Artificial Sequence: Synthetic oligonucleotide
  modified_base (34)..(37): a, c, t, g, unknown or other
acactctttccctacacgacgctcttccgatctnnnngctggtcttctttcccctcc

SEQ ID NO: 913 - DNA, 59 bp, Artificial Sequence
  Description of Artificial Sequence: Synthetic oligonucleotide
  modified_base (34)..(37): a, c, t, g, unknown or other
acactctttccctacacgacgctcttccgatctnnnngccctgcttctttttctctggt

SEQ ID NO: 914 - DNA, 51 bp, Artificial Sequence
  Description of Artificial Sequence: Synthetic oligonucleotide
tggagttcagacgtgtgctcttccgatctaccattaacgcagccaacttca

SEQ ID NO: 915 - DNA, 60 bp, Artificial Sequence
  Description of Artificial Sequence: Synthetic oligonucleotide
acactctttccctacacgacgctcttccgatctcatgaggtctatggacttcaagagcaa

SEQ ID NO: 916 - DNA, 56 bp, Artificial Sequence
  Description of Artificial Sequence: Synthetic oligonucleotide
tggagttcagacgtgtgctcttccgatctcatcattgaccagagctctgggcagaa

SEQ ID NO: 917 - DNA, 60 bp, Artificial Sequence
  Description of Artificial Sequence: Synthetic oligonucleotide
acactctttccctacacgacgctcttccgatctgcacttaccagcattacttcctaaacc

SEQ ID NO: 918 - DNA, 55 bp, Artificial Sequence
  Description of Artificial Sequence: Synthetic oligonucleotide
tggagttcagacgtgtgctcttccgatctatgggctccacttttcagctctgtaa

SEQ ID NO: 919 - DNA, 57 bp, Artificial Sequence
  Description of Artificial Sequence: Synthetic oligonucleotide
acactctttccctacacgacgctcttccgatctcagttcaggcacatgtaggaggga

SEQ ID NO: 920 - DNA, 56 bp, Artificial Sequence
  Description of Artificial Sequence: Synthetic oligonucleotide
tggagttcagacgtgtgctcttccgatctaccgcctgcagctgtcggacactggca

SEQ ID NO: 921 - DNA, 56 bp, Artificial Sequence
  Description of Artificial Sequence: Synthetic oligonucleotide
acactctttccctacacgacgctcttccgatctaaaagatgagtatgcctgccgtg

SEQ ID NO: 922 - DNA, 56 bp, Artificial Sequence
  Description of Artificial Sequence: Synthetic oligonucleotide
tggagttcagacgtgtgctcttccgatctcagattgtttatatcagatgggatggg

SEQ ID NO: 923 - DNA, 59 bp, Artificial Sequence
  Description of Artificial Sequence: Synthetic oligonucleotide
acactctttccctacacgacgctcttccgatctatgcaagtttggtcctgagccctccc

SEQ ID NO: 924 - DNA, 53 bp, Artificial Sequence
  Description of Artificial Sequence: Synthetic oligonucleotide
tggagttcagacgtgtgctcttccgatctgatgtgggttccctgcgctctgca

SEQ ID NO: 925 - DNA, 57 bp, Artificial Sequence
  Description of Artificial Sequence: Synthetic oligonucleotide
acactctttccctacacgacgctcttccgatctccagggactgagggtggaaggtcc

SEQ ID NO: 926 - DNA, 52 bp, Artificial Sequence
  Description of Artificial Sequence: Synthetic oligonucleotide
tggagttcagacgtgtgctcttccgatctacctccgcctgagcagtggagaa

SEQ ID NO: 927 - DNA, 27 bp, Artificial Sequence
  Description of Artificial Sequence: Synthetic oligonucleotide
tcgagctcggtacctaatacgactcac

SEQ ID NO: 928 - DNA, 149 bp, Artificial Sequence
  Description of Artificial Sequence: Synthetic polynucleotide
ttttttttttttttttttttttttttttttttttttttttttttttttttttttttttttttttttttttttttttttttttttttttttttttttttttttttttttttttttttttttcttcctactcaggctttattcaaagacca

SEQ ID NO: 929 - RNA, 20 nt, Artificial Sequence
  Description of Artificial Sequence: Synthetic oligonucleotide
cuuaccccacuuaacuaucu

SEQ ID NO: 930 - RNA, 20 nt, Artificial Sequence
  Description of Artificial Sequence: Synthetic oligonucleotide
cccuaccugucaccaggacc

SEQ ID NO: 931 - RNA, 20 nt, Artificial Sequence
  Description of Artificial Sequence: Synthetic oligonucleotide
caccuaccuaagaaccaucc

SEQ ID NO: 932 - RNA, 20 nt, Artificial Sequence
  Description of Artificial Sequence: Synthetic oligonucleotide
cacucaccuuagccugagca

SEQ ID NO: 933 - RNA, 20 nt, Artificial Sequence
  Description of Artificial Sequence: Synthetic oligonucleotide
cuuaccugggcuggggaaga

SEQ ID NO: 934 - RNA, 20 nt, Artificial Sequence
  Description of Artificial Sequence: Synthetic oligonucleotide
auuauaccugccaugccgua

SEQ ID NO: 935 - RNA, 80 nt, Artificial Sequence; identical to SEQ ID NO: 198
  Description of Artificial Sequence: Synthetic oligonucleotide

What is claimed is:

1. A method for producing a modified immune cell, the method comprising expressing or introducing in an immune cell a nucleobase editor polypeptide and contacting the cell with two or more guide RNAs that target the nucleobase editor polypeptide to effect an alteration in a nucleic acid molecule encoding at least one polypeptide selected from the group consisting of a T Cell Receptor Alpha Constant (TRAC), beta-2 microglobulin (B2M), programmed cell death 1 (PD1), Cluster of Differentiation 7 (CD7), Cluster of Differentiation 5 (CD5), Cluster of Differentiation 33 (CD33), Cluster of Differentiation 123 (CD123), Cbl Proto-Oncogene B (CBLB), and Class II Major Histocompatibility Complex Transactivator (CIITA) polypeptide, wherein the nucleobase editor polypeptide comprises a nucleic acid programmable DNA binding protein (napDNAbp) and at least one base editor domain comprising an adenosine deaminase variant domain comprising an alteration at amino acid position 82 of SEQ ID NO. 3 and/or comprising an amino acid alteration referenced to SEQ ID NO: 3 selected from the group consisting of I76Y, Y147T, Y147R, Q154S, and T166R.

2. The method of claim 1, wherein the adenosine deaminase variant domain comprises both an alteration at amino acid position 82 and the T166R amino acid alteration.

3. The method of claim 1, wherein the adenosine deaminase variant domain comprises a V82S alteration and/or the T166R amino acid alteration.

4. The method of claim 1, wherein the adenosine deaminase variant domain further comprises one or more of the following alterations: I76Y, Y147T, Y147R, Q154S, Y123H, and Q154R.

5. The method of claim 1, wherein the adenosine deaminase variant domain comprises a combination of alterations selected from the group consisting of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

6. The method of claim 1, wherein the adenosine deaminase variant is selected from the group consisting of TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, and TadA*8.24.

7. The method of claim 1, wherein the nucleobase editor polypeptide is selected from the group consisting of ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, and ABE8.24-m.

8. The method of claim 1, wherein the base editor domain is an adenosine deaminase variant heterodimer comprising a wild-type adenosine deaminase domain and the adenosine deaminase variant domain.

9. The method of claim 1, wherein the napDNAbp comprises an amino acid sequence with at least 90% identity to SEQ ID NO: 22.

10. The method of claim 1, wherein the napDNAbp is a Staphylococcus aureus Cas9 (SaCas9), a Streptococcus thermophilus 1 Cas9 (StlCas9), a Streptococcus pyogenes Cas9 (SpCas9), or variants thereof.

11. The method of claim 1, wherein the nucleobase editor polypeptide further comprises a linker between the napDNAbp and the adenosine deaminase variant domain.

12. The method of claim 1, wherein the nucleobase editor polypeptide further comprises one or more nuclear localization signals (NLS).

13. The method of claim 1, wherein the immune cell is a T cell.

14. The method of claim 1, wherein the nucleobase editor polypeptide further comprises one or more uracil glycosylase inhibitors.

15. The method of claim 1, further comprising expressing a chimeric antigen receptor (CAR) in the modified immune cell.

16. A modified immune cell produced according to the method of claim 1.

17. The modified immune cell of claim 16, wherein the cell comprises one or more mutations in polynucleotides encoding B2M, CD7, CIITA, PD1, CBLB, and/or TRAC; TIGIT, TGFBR2, ZAP70, NFATc1, or TET2; or V-Set Immunoregulatory Receptor (VISTA), T Cell Immunoglobulin Mucin 3 (Tim-3), T Cell Immunoreceptor With Ig and ITIM Domains (TIGIT), Transforming Growth Factor Beta Receptor II (TGFbRII), Regulatory Factor X Associated Ankyrin Containing Protein (RFXANK), PVR Related Immunoglobulin Domain Containing (PVRIG), Lymphocyte-Activation Gene 3 (Lag3), Cytotoxic T-Lymphocyte Associated Protein 4 (CTLA-4), Chitinase 3 Like 1 (Chi3l1), Cluster of Differentiation 96 (CD96), B and T Lymphocyte Associated (BTLA), Tet Methylcytosine Dioxygenase 2 (TET2), Sprouty RTK Signaling Antagonist 1 (Spry1), Sprouty RTK Signaling Antagonist 2 (Spry2), Class II Major Histocompatibility Complex Transactivator (CIITA), Cluster of Differentiation 7 (CD7), Cluster of Differentiation 33 (CD33), Cluster of Differentiation 52 (CD52), Cluster of Differentiation 123 (CD123), T Cell Receptor Beta Constant 1 (TRBC1), T Cell Receptor Beta Constant 2 (TRBC2), Cytokine Inducible SH2

Containing Protein (CISH), Acetyl-CoA Acetyltransferase 1 (ACAT1), Cytochrome P450 Family 11 Subfamily A Member 1 (Cyp11a1), GATA Binding Protein 3 (GATA3), Nuclear Receptor Subfamily 4 Group A Member 1 (NR4A1), Nuclear Receptor Subfamily 4 Group A Member 2 (NR4A2), Nuclear Receptor Subfamily 4 Group A Member 3 (NR4A3), Methylation-Controlled J Protein (MCJ), Fas Cell Surface Death Receptor (FAS), or Selectin P Ligand/P-Selectin Glycoprotein Ligand-1 (SELPG/PSGL1).

18. The modified immune cell of claim 16, wherein the immune cell expresses a chimeric antigen receptor.

19. The modified immune cell of claim 18, wherein the chimeric antigen receptor comprises an extracellular domain having an affinity for a marker associated with neoplasia.

20. The modified immune cell of claim 19, wherein the neoplasia is a B cell cancer, a lymphoma, a leukemia, or multiple myeloma.

21. A method of modulating an immune response, treating a neoplasia or in a subject or treating graft-versus-host disease (GVHD) in a subject having or having a propensity to develop graft-versus-host disease, the method comprising administering an effective amount of a modified immune cell of claim 16.

22. A pharmaceutical composition or kit comprising an effective amount a modified immune cell of claim 16 in a pharmaceutically acceptable excipient.

\* \* \* \* \*